(12) United States Patent
Heard et al.

(10) Patent No.: US 7,223,904 B2
(45) Date of Patent: May 29, 2007

(54) PLANT GENE SEQUENCES II

(75) Inventors: Jacqueline Heard, San Mateo, CA (US); Omaira Pineda, Castro Valley, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 148 days.

(21) Appl. No.: 10/302,267

(22) Filed: Nov. 22, 2002

(65) Prior Publication Data

US 2003/0229915 A1 Dec. 11, 2003

Related U.S. Application Data

(62) Division of application No. 09/506,720, filed on Feb. 17, 2000, now abandoned.

(60) Provisional application No. 60/162,656, filed on Nov. 1, 1999, provisional application No. 60/161,143, filed on Oct. 22, 1999, provisional application No. 60/144,153, filed on Jul. 15, 1999, provisional application No. 60/135,134, filed on May 20, 1999, provisional application No. 60/129,450, filed on Apr. 15, 1999, provisional application No. 60/124,278, filed on Mar. 11, 1999, provisional application No. 60/121,037, filed on Feb. 22, 1999, provisional application No. 60/120,880, filed on Feb. 18, 1999.

(51) Int. Cl.
*A01H 1/00* (2006.01)
*C07H 21/04* (2006.01)
*C07K 14/415* (2006.01)
*C12N 5/14* (2006.01)
*C12N 9/00* (2006.01)

(52) U.S. Cl. .................. 800/295; 435/6; 435/69.1; 435/468; 435/419; 435/252.3; 435/320.1; 530/370; 536/23.6; 800/278

(58) Field of Classification Search ............... 435/468, 435/410, 419, 320.1, 6, 69.1, 252.3; 530/370; 536/23.6; 800/278, 289, 295
See application file for complete search history.

(56) References Cited

U.S. PATENT DOCUMENTS 5,831,060 A 11/1998 Wada et al.

OTHER PUBLICATIONS

Lee et al. The Plant Journal: for cell and molecular biology, Oct. 1995. vol. 8, No. 4, p. 603-612.*
Mayer et al., The European Union Arabidopsis Genome Sequencing Consortium & The Cold Spring Harbor, Washington University in St Louis and PE Biosystems Arabidopsis Sequencing Consortium, Nature, vol. 402, Dec. 16, 1999, p. 769-777.*
Berger, F. et al. (1998) Positional information in root epidermis is defined during embyogenesis and acts in domains with strict boundaries. Current Biol. 8: 421-430.
Casimiro, I. et al. (2003) Dissecting Arabidopsis lateral root development. Trends Plant Sci. 8: 165-171.
Costa, S., and Dolan., L. (2003) Epidermal patterning genes are active during embryogenesis in Arabidopsis. Development 130: 2893-2901.
Lee, M., and Schiefelbein, J. (1999) WEREWOLF, a MYB-related protein in Arabidopsis, is a position-dependent regulator of cell patterning. Cell 99: 473-483.
Schaffer, R. et al. (1998) The late elongated hypocotyl mutation of Arabidopsis disrupts circadian rhythyms and the photoperiodic control of flowering. Cell 93: 1219-1229.
Schellmann, S., et al. (2002) Triptychon and Caprice mediate lateral inhibition during trichome and root hair patterning in Arabidopsis. EMBO J. 21: 5036-5046.
Schiefelbein, J. (2003) Cell-fate specification in the epidermis: a common patterning mechanism in the root and shoot. Curr. Opin. Plant Biol. 6: 74-78.
Schnittger, A. (1999) Generation of a spacing pattern: the role of TRIPTYCHON in trichome patterning in Arabidopsis. Plant Cell 11: 1105-1116.
Wada, T. (1997) Epidermal cell differentiation in Arabidopsis determined by a Myb homolog, CPC. Science 277: 1113-1116.
Goff, S. (1992) Functional analysis of the transcriptional activator encoded by the maize B gene: evidence for a direct functional interaction between two classes of regulatory proteins. Genes Dev. 6: 864-875.
Hung C-Y., et al. (1998) A common position-dependent mechanism controls cell-type patterning and GLABRA2 regulation in the root and hypocotyl epidermis of Arabidopsis: Plant Physiol. 117: 73-84.
Wada, T. et al. (2002) Role of a positive regulator of root hair development, CAPRICE, in Arabidopsis root epidermal cell differentiation. Development 129: 5409-5419.
Wang, H. et al. (2002) Regulation of the cell expansion gene RHD3 during Arabidopsis development. Plant Physiol. 129: 638-649.
Zhang, F. et al. (2003) A network of redundant bHLH proteins function sin all TTG1-dependent pathways of Arabidopsis. Development 130: 4859-4869.
Washington University Genome Sequencing Center (1997) *Arabidopsis thaliana* BAC IG002NO1, NCBI acc. No. AF0007269 (bases 113014 to 113446).
Pogue, G.P. et al., (Feb. 15, 2002) "Methods of creating dwarf phenotypes in plants", GenBank Accessi on No. AX366159, GI: 18697584.
Reichmann and Meyerowitz, *The AP2/EREBP Family Transcription Factors*, J. Biol. Chem. (1998) 379:633-646.
Martin and Paz-Ares, *MYB transcription factors in plants*, Trends Genet. (1997)13:67-73.

(Continued)

*Primary Examiner*—Phuong T. Bui
(74) *Attorney, Agent, or Firm*—Jeffrey Libby

(57) ABSTRACT

Compositions and methods are provided for modifying a trait of a plant. Isolated polynucleotide and polypeptide sequences are provided, along with an expression vector comprising the isolated polynucleotide, a host cell comprising the isolated polynucleotide, and a transgenic plant comprising the isolated polynucleotide. Also provided is a method for producing a transgenic plant, a method for screening for a compound that may modify the trait and a method for identifying other homologous polynucleotide and polypeptide sequences.

5 Claims, No Drawings

OTHER PUBLICATIONS

Reichmann and Meyerowitz, *MADS Domain Proteins in Plant Development*, Biol. Chem. (1997) 378:1079-1101.

Ishiguro and Nakamura, *Characterization of cDNA encoding a novel DNA-binding protein, SPF1, that . . .* , Mol. Gen. Genet. (1994) 244:563-571.

Zhang et al., *Expression of Antisense or Sense RNA of an Ankyrin Repeat-Containing Gene . . .* , The Plant Cell (1992) 4:1575-1588.

Klug and Schwabe, *Zinc fingers*, FASEB J. (1995) 9:597-604.

Duboule, *Guidebook to the Homebox Genes*, Oxford University Press, Oxford, UK (1994) pp. 27-71.

Forsburg and Guarente, *Identification and characterization of HAP4: a third component of the . . .* , Genes Dev. (1989) 3:1166-1178.

Klein et al., *A new family of DNA binding proteins includes putative transcriptional regulators of . . .* , Mol. Gen. Genet. (1996) 250:7-16.

Souer et al., *The No Apical Meristem Gene of Petunia Is Required for Pattern Formation in Embryos and . . .* , Cell (1996) 85:159-170.

Rouse et al., *Changes in Auxin Response from Mutations in an AUX/IAA Gene*, Science 279:1371 (1998) 279:1371-1373.

Tucker et al., *Crystal structure of the adenovirus DNA binding protein reveals a hook-on model . . .* , EMBO J. (1994) 13:2994-3002.

Foster et al., *Plant bZIP proteins gather at ACGT elements*, FASEB J. (1994) 8:192-200.

Da Costa e Silva et al., *BPF-1, a pathogen-induced DNA-binding protein involved in the plant defense response*, The Plant J. (1993) 4:125-135.

Di Laurenzio et al., *The SCARECROW Gene Regulates an Asymmetric Cell Division That Is Essential . . .* , Cell (1996) 86:423-433.

Wu et al., *The Arabidopsis 14-3-3 Multigene Family*, Plant Physiol. (1997) 114:1421-1431.

Glraudat et al., *Isolation of the Arabidopsis AB13 Gene by Positional Cloning*, The Plant Cell (1992) 4:1251-1261.

Chao et al., *Activation of the Ethylene Gas Response Pathway in Arabidopsis by the Nuclear Protein . . .* , Cell (1997) 89:1133-1144.

Bowman et al., *Crabs Claw, a gene that regulates carpel and nectary developments in Arabidopsis, encodes a novel protein . . .* , Development (1999) 126:2387-2396.

Bohmert et al., *AGO1 defines a novel locus of Aribidopsis controlling leaf development*, EMBO J. (1998) 17:170-180.

Kim et al., *Isolation of a novel class of bZIP transcription factors that ineract with ABA-responsive and embryo-specification elements . . .* , The Plant J. (1997) 11:1237-1251.

Hall et al., *GOLDEN 2: A Novel Transcriptional Regulator of Cellular Differentiation in the Maize Leaf.* The Plant Cell (1998) 10:925-936.

Reichmann et al., *Arabidopsis Transcription Factors: Genome-Wide Comparative Analysis Among Eukaryotes*, Science (2000) 290:2105-2110.

Bird et al., *The tomato polygalacturonase gene and ripening-specific expressin in transgenic plants*, Plant Mol Biol (1988) 11:651-662.

Ringli et al., *Specific interactionof the tomato bZIP tanscription factor VSF-1 with a non-palindromic DNA sequence that controls vascular gene expression*, Plant Mol Biol (1998) 37:977-988.

Kaiser et al., *Cis-acting elements of the CHSI gene from white mustard controlling . . .* , Plant Mol Biol (1995) 28:231-243.

Baerson et al., *Identification of domains in an Arabidopsis acyl carrier protein gene . . .* , Plant Mol Biol (1994) 26:1947-1959.

Ohl et al., *Functional Properties of a Phenylalanine Ammonia-Lyase Promoter from Arabidopsis*, The Plant Cell (1990) 2:837-848.

Baerson et al., *Developmental regulation of an acyl carrier protein gene promoter in vegetative and reproductive tissues*, Plant Mol Biol (1993) 22:255-267.

van der Kop et al., *Selection of Arabidopsis mutants overexpressing genes driven by the promoter . . .* , Plant Mol Bl 1 (1999) 39:979-990.

Baumann et al., *The DNA Binding Site of the Dof Protein NtBBF1 Is Essential for TIssue-Specific . . .* , The Plant Cell (1999) 11:323-333.

Guevara-Garcia, *A 42 bp fragment of the pamas1' containing an ocs-like element confers a development, wound- and chemically . . .* , Plant Mol Biol (1998) 38:743-753.

Shi et al., *Gibberellin and abscisie acids regulate GAST1 expression at the level of transcription*, Plant Mol Biol (1998) 38:1053-1060.

Willmott et al., *Dnase1 footprints suggest the involvement of at least three types of transcription factors in the regulation . . .* , Plant Mol Bio (1998) 38:817-825.

Ainley et al., *Regulatable endogenous production of cytokinins up to 'toxic' levels in transgenic plants and plant tissues*, The Plant Mol Biol (1993) 22:13-23.

Kuhlemeier et al., *The Pea rbcS-3A Promoter Mediates Light Responsiveness but not Organ Specificity*, The Plant Cell (1989) 1:471-478.

Schaffner and Sheet, *Maize rbcS Promoter Depends on Sequence Elements Not Found In Dicot recS Promoters*, The Plant Cell (1991) 3:997-1012.

Siebertz et al., *cis-Analysis of the Wound-Inducible Promoter wun1 in Transgenic Tobacco Plants and HIstochemical Locallzation of Its Expression*, The Plant Cell (1989) 1:961-968.

C. Gatz, *Chemical Control of Gene Expression*, Annu. Rev. Plant Physiol. Plant Mol Biol (1997) 48:89-108.

Gan and Amasino, *Inhibition of Leaf Senescence by Autoregulated Production of Cytokinin*, Science (1995) 270:1986-1988.

Odell et al., *Seed-Specific Gene Activation Mediated by the Cre/Iox Site-Specific Recombination System*, Plant Physiol (1994) 106:447-458.

\* cited by examiner

PLANT GENE SEQUENCES II

The present invention is a divisional application of prior U.S. application Ser. No. 09/506,720, filed Feb. 17, 2000 (now abandoned); and the present application claims benefit of prior U.S. Provisional Application Ser. Nos. 60/120,880 filed Feb. 18, 1999; 60/121,037 filed Feb. 22, 1999; 60/124,278 filed Mar. 11, 1999; 60/129,450 filed Apr. 15, 1999; 60/135,134 filed May 20, 1999; 60/144,153 filed Jul. 15, 1999; 60/161,143 filed Oct. 22, 1999; and 60/162,656 filed Nov. 1, 1999.

The claimed invention, in the field of functional genomics and the characterization of plant genes for the improvement of plants, was made by or on behalf of Mendel Biotechnology, Inc. and Monsanto Corporation as a result of activities undertaken within the scope of a joint research agreement, said agreement having been in effect on or before the date the claimed invention was made.

FIELD OF THE INVENTION

This invention is in the field of plant molecular biology and relates to compositions and methods for modifying a plant's traits.

BACKGROUND OF THE INVENTION

Gene expression levels are controlled in part at the level of transcription, and transcription is affected by transcription factors. Transcription factors regulate gene expression throughout the life cycle of an organism and so are responsible for differential levels of gene expression at various developmental stages, in different tissue and cell types, and in response to different stimuli. Transcription factors may interact with other proteins or with specific sites on a target gene sequence to activate, suppress or otherwise regulate transcription. In addition, the transcription of the transcription factors themselves may be regulated.

Because transcription factors are key controlling elements for biological pathways, altering the expression levels of one or more transcription factors may change entire biological pathways in an organism. For example, manipulation of the levels of selected transcription factors may result in increased expression of economically useful proteins or metabolic chemicals in plants or to improve other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits.

The present invention provides novel transcription factors for use in modifying a plant's traits.

SUMMARY OF THE INVENTION

In one aspect, the present invention relates to an isolated polynucleotide comprising a nucleotide sequence encoding a transcription factor. In one embodiment, the polynucleotide is a sequence provided in the Sequence Listing as SEQ ID NO: 1 (G274), SEQ ID NO: 3 (G820), SEQ ID NO: 5 (G823), SEQ ID NO: 7 (G1186), SEQ ID NO: 9 (G1190), SEQ ID NO: 11 (G1090), SEQ ID NO: 13 (G1277), SEQ ID NO: 15 (G1380), SEQ ID NO: 17 (G1067), SEQ ID NO: 19 (G1216), SEQ ID NO: 21 (G295), SEQ ID NO: 23 (G555), SEQ ID NO: 25 (G571), SEQ ID NO: 27 (G580), SEQ ID NO: 29 (G631), SEQ ID NO: 31 (G732), SEQ ID NO: 33 (G886), SEQ ID NO: 35 (G1050), SEQ ID NO: 37 (G1052), SEQ ID NO: 39 (G1053), SEQ ID NO: 41 (G1055), SEQ ID NO: 43 (G1057), SEQ ID NO: 45 (G1089), SEQ ID NO: 47 (G1145), SEQ ID NO: 49 (G1198), SEQ ID NO: 51 (G1278), SEQ ID NO: 53 (G1366), SEQ ID NO: 55 (G929), SEQ ID NO: 57 (G931), SEQ ID NO: 59 (G795), SEQ ID NO: 61 (G805), SEQ ID NO: 63 (G1398), SEQ ID NO: 65 (G723), SEQ ID NO: 67 (G725), SEQ ID NO: 69 (G1039), SEQ ID NO: 71 (G1435), SEQ ID NO: 73 (G1490), SEQ ID NO: 75 (G395), SEQ ID NO: 77 (G780), SEQ ID NO: 79 (G784), SEQ ID NO: 81 (G789), SEQ ID NO: 83 (G791), SEQ ID NO: 85 (G792), SEQ ID NO: 87 (G1061), SEQ ID NO: 89 (G1062), SEQ ID NO: 91 (G1133), SEQ ID NO: 93 (G1134), SEQ ID NO: 95 (G1664), SEQ ID NO: 97 (G447), SEQ ID NO: 99 (G467), SEQ ID NO: 101 (G716), SEQ ID NO: 103 (G991), SEQ ID NO: 105 (G1267), SEQ ID NO: 107 (G1025), SEQ ID NO: 109 (G1212), SEQ ID NO: 111 (G1219), SEQ ID NO: 113 (G1228), SEQ ID NO: 115 (G1232), SEQ ID NO: 117 (G1233), SEQ ID NO: 119 (G1236), SEQ ID NO: 121 (G1240), SEQ ID NO: 123 (G1242), SEQ ID NO: 125 (G1243), SEQ ID NO: 127 (G1300), SEQ ID NO: 129 (G1322), SEQ ID NO: 131 (G1318), SEQ ID NO: 133 (G1326), SEQ ID NO: 135 (G1269), SEQ ID NO: 137 (G1308), SEQ ID NO: 139 (G1311), SEQ ID NO: 141 (G1313), SEQ ID NO: 143 (G1314), SEQ ID NO: 145 (G1315), SEQ ID NO: 147 (G1317), SEQ ID NO: 149 (G1319), SEQ ID NO: 151 (G1324), SEQ ID NO: 153 (G1325), SEQ ID NO: 155 (G1327), SEQ ID NO: 157 (G1362), SEQ ID NO: 159 (G665), SEQ ID NO: 161 (G682), SEQ ID NO: 163 (G998), SEQ ID NO: 165 (G759), SEQ ID NO: 167 (G760), SEQ ID NO: 169 (G764), SEQ ID NO: 171 (G765), SEQ ID NO: 173 (G1426), SEQ ID NO: 175 (G1425), SEQ ID NO: 177 (G1412), SEQ ID NO: 179 (G746), SEQ ID NO: 181 (G752), SEQ ID NO: 183 (G1395), SEQ ID NO: 185 (G477), SEQ ID NO: 187 (G1552), SEQ ID NO: 189 (G636), SEQ ID NO: 191 (G638), SEQ ID NO: 193 (G639), SEQ ID NO: 195 (G640), SEQ ID NO: 197 (G1382), SEQ ID NO: 199 (G1669), SEQ ID NO: 201 (G901), SEQ ID NO: 203 (G903), SEQ ID NO: 205 (G2119) or SEQ ID NO: 207 (G2120).

In another embodiment, the polynucleotide of the invention is one that is homologous to a polynucleotide provided in the Sequence Listing as determined under stringent hybridization conditions or by the analysis of sequence identity criteria. In yet another embodiment, the polynucleotide may comprise a sequence comprising a fragment of at least 15 consecutive nucleotides of a polynucleotide sequence of the invention. The polynucleotide may further comprise a promoter operably linked to the sequence. The promoter may be a constitutive, an inducible or a tissue-active promoter.

In a second aspect, the present invention relates to an isolated polypeptide that is a transcription factor. In one embodiment, the polypeptide comprises a sequence provided in the Sequence Listing as SEQ ID NO: 2 (G274 prot), SEQ ID NO: 4 (G820 prot), SEQ ID NO: 6 (G823 prot), SEQ ID NO: 8 (G1186 prot), SEQ ID NO: 10 (G1190 prot), SEQ ID NO: 12 (G1090 prot), SEQ ID NO: 14 (G1277 prot), SEQ ID NO: 16 (G1380 prot), SEQ ID NO: 18 (G1067 prot), SEQ ID NO: 20 (G1216 prot), SEQ ID NO: 22 (G295 prot), SEQ ID NO: 24 (G555 prot), SEQ ID NO: 26 (G571 prot), SEQ ID NO: 28 (G580 prot), SEQ ID NO: 30 (G631 prot), SEQ ID NO: 32 (G732 prot), SEQ ID NO: 34 (G886 prot), SEQ ID NO: 36 (G1050 prot), SEQ ID NO: 38 (G1052 prot), SEQ ID NO: 40 (G1053 prot), SEQ ID NO: 42 (G1055 prot), SEQ ID NO: 44 (G1057 prot), SEQ ID NO: 46 (G1089 prot), SEQ ID NO: 48 (G1145 prot), SEQ ID NO: 50 (G1198 prot), SEQ ID NO: 52 (G1278 prot), SEQ ID NO: 54 (G1366 prot), SEQ ID NO: 56 (G929 prot), SEQ ID NO: 58 (G931 prot), SEQ ID NO: 60 (G795 prot), SEQ ID NO: 62 (G805 prot), SEQ ID NO: 64 (G1398 prot), SEQ ID NO: 66 (G723 prot), SEQ ID NO: 68 (G725 prot), SEQ ID NO: 70 (G1039 prot), SEQ ID NO: 72 (G1435 prot), SEQ ID NO: 74 (G1490 prot), SEQ ID NO: 76 (G395 prot), SEQ ID NO: 78 (G780 prot), SEQ ID NO: 80 (G784 prot), SEQ ID NO: 82 (G789 prot), SEQ ID NO: 84 (G791 prot), SEQ ID NO: 86 (G792 prot), SEQ ID NO: 88 (G1061 prot), SEQ ID NO: 90 (G1062 prot), SEQ ID NO: 92 (G1133 prot), SEQ ID NO: 94 (G1134 prot), SEQ ID NO: 96 (G1664 prot), SEQ ID NO: 98 (G447 prot), SEQ ID NO: 100 (G467 prot), SEQ ID NO: 102 (G716 prot), SEQ ID NO: 104 (G991 prot), SEQ ID NO: 106 (G1267 prot), SEQ ID NO: 108 (G1025 prot), SEQ ID NO: 110 (G1212 prot), SEQ ID NO: 112 (G1219 prot), SEQ ID NO: 114 (G1228 prot), SEQ ID NO: 116 (G1232 prot), SEQ ID NO: 118 (G1233 prot), SEQ ID NO: 120 (G1236 prot), SEQ ID NO: 122 (G1240 prot), SEQ ID NO: 124 (G1242 prot), SEQ ID NO: 126 (G1243 prot), SEQ ID NO: 128 (G1300 prot), SEQ ID NO: 130 (G1322 prot), SEQ ID NO: 132 (G1318 prot), SEQ ID NO: 134 (G1326 prot), SEQ ID NO: 136 (G1269 prot), SEQ ID NO: 138 (G1308 prot), SEQ ID NO: 140 (G131 1 prot), SEQ ID NO: 142 (G1313 prot), SEQ ID NO: 144 (G1314 prot), SEQ ID) NO: 146 (G1315 prot), SEQ ID NO: 148 (G1317 prot), SEQ ID NO: 150 (G1319 prot), SEQ ID NO: 152 (G1324 prot), SEQ ID NO: 154 (G1325 prot), SEQ ID NO: 156 (G1327 prot), SEQ ID NO: 158 (G1362 prot), SEQ ID NO: 160 (G665 prot), SEQ ID NO: 162 (G682 prot), SEQ ID NO: 164 (G998 prot), SEQ ID NO: 166 (G759 prot), SEQ ID NO: 168 (G760 prot), SEQ ID NO: 170 (G764 prot), SEQ ID NO: 172 (G765 prot), SEQ ID NO: 174 (G1426 prot), SEQ ID NO: 176 (G1425 prot), SEQ ID NO: 178 (G1412 prot), SEQ ID NO: 180 (G746 prot), SEQ ID NO: 182 (G752 prot), SEQ ID NO: 184 (G1395 prot), SEQ ID NO: 186 (G477 prot), SEQ ID NO: 188 (G1552 prot), SEQ ID NO: 190 (G636 prot), SEQ ID NO: 192 (G638 prot), SEQ ID NO: 194 (G639 prot), SEQ ID NO: 196 (G640 prot), SEQ ID NO: 198 (G1382 prot), SEQ ID NO: 200 (G1669 prot), SEQ ID NO: 202 (G901 prot), SEQ ID NO: 204 (G903 prot), SEQ ID NO: 206 (G2119 prot) or SEQ ID NO: 208 (G2120 prot).

In another embodiment, the polypeptide comprises a sequence with one or more substitutions, deletions or insertions to a sequence provided in the Sequence Listing or a sequence which when ectopically expressed in a plant modifies a plant trait in a similar manner as a sequence provided in the Sequence Listing. The polypeptide may also comprise a fragment of at least 6 consecutive amino acids of a sequence provided in the Sequence Listing.

The invention also comprises an expression vector comprising a polynucleotide described above, a host cell comprising the expression vector or a transgenic plant comprising an isolated polynucleotide or polypeptide described above.

The invention also provides a method for producing a transgenic plant comprising an isolated polynucleotide or polypeptide described above. The method comprises (a) providing an isolated polynucleotide of the invention; (b) introducing said isolated polynucleotide in a plant to generate a transgenic plant; and (c) selecting a transgenic plant comprising the polynucleotide or polypeptide.

In another aspect the invention provides a method for screening for one or more molecules to identify a molecule that modifies the expression of a polynucleotide or polypeptide of the invention in a plant. The method entails (a) placing the molecule in contact with the plant; and (b) monitoring the effect of the molecule on the expression of the polynucleotide or polypeptide in the plant.

In yet another aspect, the invention provides a method for identifying a sequence homologous to a polynucleotide or polypeptide sequence provided in the Sequence Listing. The method comprises (a) providing a database sequence; (b) aligning and comparing the sequence provided with the database sequence to determine whether the database sequence meets sequence identity criteria relative to the sequence provided herein; and (c) selecting any database sequence that meets the sequence identity criteria. The present invention also encompasses a homologous polypeptide or polynucleotide identified by the method and a transgenic plant comprising the homologous sequence.

The invention further provides a method for screening for a transcription factor that modifies a plant trait, said method comprising (a) generating one or more transgenic plants ectopically expressing a polynucleotide of claim 1 and (b) identifying from said generated transgenic plants a plant with a modified plant trait.

DETAILED DESCRIPTION OF THE INVENTION DEFINITIONS

A "polynucleotide" is a nucleotide sequence comprising a gene coding sequence or a fragment thereof (comprising at least 15 consecutive nucleotides, preferably at least 30 consecutive nucleotides, and more preferably at least 50 consecutive nucleotides). Additionally, the polynucleotide may comprise a promoter, an intron, an enhancer region, a polyadenylation site, a translation initiation site, 5' or 3' untranslated regions, a reporter gene, a selectable marker or the like. The polynucleotide may comprise single stranded or double stranded DNA or RNA. The polynucleotide may comprise modified bases or a modified backbone. The polynucleotide may be genomic, a transcript (such as an mRNA) or a processed nucleotide sequence (such as a cDNA). The polynucleotide may comprise a sequence in either sense or antisense orientations.

An "isolated polynucleotide" is a polynucleotide that is not in its native state, e.g., the polynucleotide is comprised of a nucleotide sequence not found in nature or the polynucleotide is separated from nucleotide sequences with which it typically is in proximity or is next to nucleotide sequences with which it typically is not in proximity.

An "isolated polypeptide" is a polypeptide derived from the translation of an isolated polynucleotide or is more enriched in a cell than the polypeptide in its natural state in a wild type cell, e.g. more than 5% enriched, more than 10% enriched or more than 20% enriched and is not the result of a natural response of a wild type plant or is separated from other components with which it is typically associated with in a cell.

A "transgenic plant" may refer to a plant that contains genetic material not normally found in a wild type plant of the same species, or in a naturally occurring variety or in a cultivar, and which has been introduced into the plant by human manipulation. A transgenic plant is a plant that may contain an expression vector or cassette. The expression cassette comprises a gene coding sequence and allows for the expression of the gene coding sequence. The expression cassette may be introduced into a plant by transformation or by breeding after transformation of a parent plant.

A transgenic plant refers to a whole plant as well as to a plant part, such as seed, fruit, leaf, or root, plant tissue, plant cells or any other plant material, and progeny thereof.

The phrase "ectopically expressed" in reference to polynucleotide or polypeptide expression refers to an expression pattern in the transgenic plant that is different from the expression pattern in the wild type plant or a reference; for example, by expression in a cell type other than a cell type in which the sequence is expressed in the wild type plant, or by expression at a time other than at the time the sequence is expressed in the wild type plant, or by a response to different inducible agents, such as hormones or environmental signals, or at different expression levels (either higher or lower) compared with those found in a wild type plant. The term also refers to lowering the levels of expression to below the detection level or completely abolishing expression. The resulting expression pattern may be transient or stable, constitutive or inducible.

A "transcription factor" (TF) refers to a polypeptide that controls the expression of a gene or genes either directly by binding to one or more nucleotide sequences associated with a gene coding sequence or indirectly by affecting the level or activity of other polypeptides that do bind directly or indirectly to one or more nucleotide sequences associated with a gene coding sequence. A TF, in this definition, includes any polypeptide that can activate or repress transcription of a single gene or a number of genes. This polypeptide group includes, but is not limited to, DNA binding proteins, protein kinases, protein phosphatases, GTP-binding proteins and receptors.

The transcription factor sequence may comprise a whole coding sequence or a fragment or domain of a coding sequence. A "fragment or domain", as referred to polypeptides, may be a portion of a polypeptide which performs at least one biological function of the intact polypeptide in substantially the same manner or to a similar extent as does the intact polypeptide. A fragment may comprise, for example, a DNA binding domain that binds to a specific DNA promoter region, an activation domain or a domain for protein-protein interactions. Fragments may vary in size from as few as 6 amino acids to the length of the intact polypeptide, but are preferably at least 30 amino acids in length and more preferably at least 60 amino acids in length. In reference to a nucleotide sequence "a fragment" refers to any sequence of at least 15 consecutive nucleotides, preferably at least 30 nucleotides, more preferably at least 50, of any of the sequences provided herein and as an example include nucleotides 1–100, 101–200, 201–300, 501–600, 801–900, 1000–1015, or 1101–1300 of SEQ ID NO: 1 or any of the other fragments as provided in table 1.

"Trait" refers to a physiological, morphological, biochemical or physical characteristic of a plant or particular plant material or cell. This characteristic may be visible to the human eye, such as seed or plant size, or be measured by biochemical techniques, such as the protein, starch or oil content of seed or leaves or by the observation of the expression level of genes by employing Northerns, RT PCR, microarray gene expression assays or reporter gene expression systems or be measured by agricultural observations such as stress tolerance, yield or disease resistance.

"Trait modification" refers to a detectable difference in a characteristic in a transgenic plant ectopically expressing a polynucleotide or polypeptide of the present invention relative to a plant not doing so, such as a wild type plant. The trait modification may entail at least a 5% increase or decrease in an observed trait (difference), at least a 10% difference, at least a 20% difference, at least a 30%, at least a 50%, at least a 70%, at least a 100% or a greater difference. It is known that there may be a natural variation in the modified trait. Therefore, the trait modification observed entails a change in the normal distribution of the trait in transgenic plants compared with the distribution observed in wild type plant.

Trait modifications of particular interest include those to seed (embryo), fruit, root, flower, leaf, stem, shoot, seedling or the like, including: enhanced tolerance to environmental conditions including freezing, chilling, heat, drought, water saturation, radiation and ozone; enhanced resistance to microbial, fungal or viral diseases; resistance to nematodes, decreased herbicide sensitivity, enhanced tolerance of heavy metals (or enhanced ability to take up heavy metals), enhanced growth under poor photoconditions (e.g., low light and/or short day length), or changes in expression levels of genes of interest. Other phenotypes that may be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that may be modified include cell development (such as the number of trichomes), fruit and seed size and number, yields of plant parts such as stems, leaves and roots, the stability of the seeds during storage, characteristics of the seed pod (e.g., susceptibility to shattering), root hair length and quantity, internode distances, or the quality of seed coat. Plant growth characteristics that may be modified include growth rate, germination rate of seeds, vigor of plants and seedlings, leaf and flower senescence, male sterility, apomixis, flowering time, flower abscission, rate of nitrogen uptake, biomass or transpiration characteristics, as well as plant architecture characteristics such as apical dominance, branching patterns, number of organs, organ identity, organ shape or size.

1. The Sequences

We have discovered novel polynucleotides and polypeptides that are plant transcription factors (TFs). The plant transcription factors are derived from *Arabidopsis thaliana* and may belong to one of the following transcription factor families: the AP2 (APETALA2) domain transcription factor family (Riechmann and Meyerowitz (1998) *J. Biol. Chem.* 379:633–646); the MYB transcription factor family (Martin and Paz-Ares, (1997) *Trends Genet.* 13:67–73); the MADS domain transcription factor family (Riechmann and Meyerowitz (1997) *J. Biol. Chem.* 378:1079–1101); the WRKY protein family (Ishiguro and Nakamura (1994) *Mol. Gen. Genet.* 244:563–571); the ankyrin-repeat protein family (Zhang et al. (1992) *Plant Cell* 4:1575–1588); the zinc finger protein (Z) family (Klug and Schwabe (1995) *FASEB J.* 9: 597–604); the homeobox (HB) protein family (Duboule (1994) *Guidebook to the Homeobox Genes,* Oxford University Press); the CAAT-element binding proteins (Forsburg and Guarente (1989) *Genes Dev.* 3:1166–1178); the squamosa promoter binding proteins (SPB) (Klein et al. (1996) *Mol. Gen. Genet.* 1996 250:7–16); the NAM protein family (Souer et al. (1996) Cell 85:159–170); the IAA/AUX proteins (Rouse et al. (1998) *Science* 279:1371–1373); the HLH/MYC protein family (Littlewood et al. (1994) *Prot. Profile* 1:639–709); the DNA-binding protein (DBP) family (Tucker et al. (1994) *EMBO J.* 13:2994–3002); the bZIP family of transcription factors (Foster et al. (1994) *FASEB J.*

8:192–200); the Box P-binding protein (the BPF-1) family (da Costa e Silva et al. (1993) *Plant J.* 4:125–135); the high mobility group (HMG) family (Bustin and Reeves (1996) *Prog. Nucl. Acids Res. Mol. Biol.* 54:35–100); the scarecrow (SCR) family (Di Laurenzio et al. (1996) *Cell* 86:423–433); the GF14 family (Wu et al. (1997) *Plant Physiol.* 114: 1421–1431); the polycomb (PCOMB) family (Kennison (1995) *Annu. Rev. Genet.* 29:289–303); the teosinte branched (TEO) family (Luo et al. (1996) *Nature* 383: 794–799; the ABI3 family (Giraudat et al. (1992) *Plant Cell* 4:1251–1261); the triple helix (TH) family (Dehesh et al. (1990) *Science* 250:1397–1399); the EIL family (Chao et al. (1997) *Cell* 89:1133–44); the AT-HOOK family (Reeves and Nissen (1990) *Journal of Biological Chemistry* 265:8573–8582); the S1FA family (Zhou et al. (1995) *Nucleic Acids Res.* 23:1165–1169); the bZIPT2 family (Lu and Ferl (1995) *Plant Physiol.* 109:723); the YABBY family (Bowman et al. (1999) *Development* 126:2387–96); the PAZ family (Bohmert et al. (1998) *EMBO J.* 17:170–80); a family of miscellaneous (MISC) transcription factors including the DPBF family (Kim et al. (1997) *Plant J.* 11:1237–1251) and the SPF1 family (Ishiguro and Nakamura (1994) *Mol. Gen. Genet.* 244:563–571); the golden (GLD) family (Hall et al. (1998) *Plant Cell* 10:925–936 and the kinase family (Grahame Hardie (1995) *The Protein Kinase Factsbook,* Academic Press Inc.). SEQ ID NO: 207 and 208 represent a member of the kinase family.

The novel polynucleotides and polypeptides are provided in the Sequence Listing and are tabulated in Table 1. Table 1 identifies a SEQ ID No., its corresponding GID number, the transcription factor family to which the sequence belongs, fragments derived from the sequences and whether the sequence is a polynucleotide or a polypeptide sequence. Producing transgenic plants with modified expression levels of one or more of these transcription factors compared with those levels found in a wild type plant may be used to modify a plant's traits. The effect of modifying the expression levels of a particular transcription factor on the traits of a transgenic plant is described further in the Examples.

We have also identified domains or fragments derived from the sequences. The numbers indicating the fragment location for the cDNA sequences may be from either 5' or 3' end of the cDNA. For the protein sequences the fragment location is determined from the N-terminus of the protein and may include adjacent amino acid sequences, such as for example for SEQ ID No. 2 an additional 10, 20, 40, 60 or 100 amino acids in either N-terminal or C-terminal direction of the described fragments.

TABLE 1

| SEQ ID NO. | GID No. | Family | Fragments | cDNA or protein |
|---|---|---|---|---|
| 1 | G274 | AKR | 1–100, 30–45, 75–125, 150–200, 200–300, 350–400 | cDNA |
| 2 | G274 | AKR | 205–254 | protein |
| 3 | G820 | AKR | 1–100, 30–45, 75–125, 150–200, 200–300, 350–400 | cDNA |
| 4 | G820 | AKR | 272–322 | protein |
| 5 | G823 | AKR | 1–100, 30–45, 75–125, 150–200, 200–300, 350–400 | cDNA |
| 6 | G823 | AKR | 210–256 | protein |
| 7 | G1186 | AKR | 1–100, 30–45, 75–125, 150–200, 200–300, 350–400 | cDNA |
| 8 | G1186 | AKR | 230–279 | protein |
| 9 | G1190 | AKR | 1–100, 30–45, 75–125, 150–200, 200–300, 350–400 | cDNA |
| 10 | G1190 | AKR | 197–246 | protein |
| 11 | G1090 | AP2 | 1–100, 30–45, 75–125, 150–200, 200–300, 350–400 | cDNA |
| 12 | G1090 | AP2 | 17–84 | protein |
| 13 | G1277 | AP2 | 1–100, 30–45, 75–125, 150–200, 200–300, 350–400 | cDNA |
| 14 | G1277 | AP2 | 18–85 | protein |
| 15 | G1380 | AP2 | 1–100, 30–45, 75–125, 150–200, 200–300, 350–400 | cDNA |
| 16 | G1380 | AP2 | 24–91 | protein |
| 17 | G1067 | AT-Hook | 1–100, 30–45, 75–125, 150–200, 200–300, 350–400 | cDNA |
| 18 | G1067 | AT-Hook | 87–102, 178–193 | protein |
| 19 | G1216 | BPF-1 | 1–100, 30–45, 75–125, 150–200, 200–300, 350–400 | cDNA |
| 20 | G1216 | BPF-1 | 468–542 | protein |
| 21 | G295 | bZIP | 1–100, 30–45, 75–125, 150–200, 200–300, 350–400 | cDNA |
| 22 | G295 | bZIP | 301–326 | protein |
| 23 | G555 | bZIP | 1–100, 30–45, 75–125, 150–200, 200–300, 350–400 | cDNA |
| 24 | G555 | bZIP | 52–77 | protein |
| 25 | G571 | bZIP | 1–100, 30–45, 75–125, 150–200, 200–300, 350–400 | cDNA |
| 26 | G571 | bZIP | 168–193 | protein |
| 27 | G580 | bZIP | 1–100, 30–45, 75–125, 150–200, 200–300, 350–400 | cDNA |
| 28 | G580 | bZIP | 171–196 | protein |
| 29 | G631 | bZIP | 1–100, 30–45, 75–125, 150–200, 200–300, 350–400 | cDNA |
| 30 | G631 | bZIP | 219–244 | protein |
| 31 | G732 | bZIP | 1–100, 30–45, 75–125, 150–200, 200–300, 350–400 | cDNA |
| 32 | G732 | bZIP | 37–62 | protein |
| 33 | G886 | bZIP | 1–100; 30–45, 75–125, 150–200, 200–300, 350–400 | cDNA |
| 34 | G886 | bZIP | 544–574 | protein |
| 35 | G1050 | bZIP | 1–100, 30–45, 75–125, 150–200, 200–300, 350–400 | cDNA |
| 36 | G1050 | bZIP | 380–405 | protein |
| 37 | G1052 | bZIP | 1–100, 30–45, 75–125, 150–200, 200–300, 350–400 | cDNA |
| 38 | G1052 | bZIP | 210–235 | protein |
| 39 | G1053 | bZIP | 1–100, 30–45, 75–125, 150–200, 200–300, 350–400 | cDNA |
| 40 | G1053 | bZIP | 81–106 | protein |
| 41 | G1055 | bZIP | 1–100, 30–45, 75–125, 150–200, 200–300, 350–400 | cDNA |
| 42 | G1055 | bZIP | 199–224 | protein |
| 43 | G1057 | bZIP | 1–100, 30–45, 75–125, 150–200, 200–300, 350–400 | cDNA |
| 44 | G1057 | bZIP | 315–340 | protein |

TABLE 1-continued

| SEQ ID NO. | GID No. | Family | Fragments | cDNA or protein |
|---|---|---|---|---|
| 45 | G1089 | bZIP | 1–100, 30–45, 75–125, 150–200, 200–300, 350–400 | cDNA |
| 46 | G1089 | bZIP | 434–464 | protein |
| 47 | G1145 | bZIP | 1–100, 30–45, 75–125, 150–200, 200–300, 350–400 | cDNA |
| 48 | G1145 | bZIP | 233–258 | protein |
| 49 | G1198 | bZIP | 1–100, 30–45, 75–125, 150–200, 200–300, 350–400 | cDNA |
| 50 | G1198 | bZIP | 184–209 | protein |
| 51 | G1278 | bZIP | 1–100, 30–45, 75–125, 150–200, 200–300, 350–400 | cDNA |
| 52 | G1278 | bZIP | 338–363 | protein |
| 53 | G1366 | bZIP | 1–100, 30–45, 75–125, 150–200, 200–300, 350–400 | cDNA |
| 54 | G1366 | bZIP | 22–47 | protein |
| 55 | G929 | CAAT | 1–100, 30–45, 75–125, 150–200, 200–300, 350–400 | cDNA |
| 56 | G929 | CAAT | 99–158 | protein |
| 57 | G931 | CAAT | 1–100, 30–45, 75–125, 150–200, 200–300, 350–400 | cDNA |
| 58 | G931 | CAAT | 171–233 | protein |
| 59 | G795 | DBP | 1–100, 30–45, 75–125, 150–200, 200–300, 350–400 | cDNA |
| 60 | G795 | DBP | 251–262 | protein |
| 61 | G805 | DBP | 1–100, 30–45, 75–125, 150–200, 200–300, 350–400 | cDNA |
| 62 | G805 | DBP | 72–89 | protein |
| 63 | G1398 | DBP | 1–100, 30–45, 75–125, 150–200, 200–300, 350–400 | cDNA |
| 64 | G1398 | DBP | 163–184 | protein |
| 65 | G723 | GLD | 1–100, 30–45, 75–125, 150–200, 200–300, 350–400 | cDNA |
| 66 | G723 | GLD | 152–199 | protein |
| 67 | G725 | GLD | 1–100, 30–45, 75–125, 150–200, 200–300, 350–400 | cDNA |
| 68 | G725 | GLD | 39–87 | protein |
| 69 | G1039 | GLD | 1–100, 30–45, 75–125, 150–200, 200–300, 350–400 | cDNA |
| 70 | G1039 | GLD | 214–263 | protein |
| 71 | G1435 | GLD | 1–100, 30–45, 75–125, 150–200, 200–300, 350–400 | cDNA |
| 72 | G1435 | GLD | 146–194 | protein |
| 73 | G1490 | GLD | 1–100, 30–45, 75–125, 150–200, 200–300, 350–400 | cDNA |
| 74 | G1490 | GLD | 193–241 | protein |
| 75 | G395 | HB | 1–100, 30–45, 75–125, 150–200, 200–300, 350–400 | cDNA |
| 76 | G395 | HB | 220–239 | protein |
| 77 | G780 | HLH/MYC | 1–100, 30–45, 75–125, 150–200, 200–300, 350–400 | cDNA |
| 78 | G780 | HLH/MYC | 461–482 | protein |
| 79 | G784 | HLH/MYC | 1–100, 30–45, 75–125, 150–200, 200–300, 350–400 | cDNA |
| 80 | G784 | HLH/MYC | 166–190 | protein |
| 81 | G789 | HLH/MYC | 1–100, 30–45, 75–125, 150–200, 200–300, 350–400 | cDNA |
| 82 | G789 | HLH/MYC | 288–312 | protein |
| 83 | G791 | HLH/MYC | 1–100, 30–45, 75–125, 150–200, 200–300, 350–400 | cDNA |
| 84 | G791 | HLH/MYC | 75–94 | protein |
| 85 | G792 | HLH/MYC | 1–100, 30–45, 75–125, 150–200, 200–300, 350–400 | cDNA |
| 86 | G792 | HLH/MYC | 100–124 | protein |
| 87 | G1061 | HLH/MYC | 1–100, 30–45, 75–125, 150–200, 200–300, 350–400 | cDNA |
| 88 | G1061 | HLH/MYC | 176–200 | protein |
| 89 | G1062 | HLH/MYC | 1–100, 30–45, 75–125, 150–200, 200–300, 350–400 | cDNA |
| 90 | G1062 | HLH/MYC | 335–356 | protein |
| 91 | G1133 | HLH/MYC | 1–100, 30–45, 75–125, 150–200, 200–300, 350–400 | cDNA |
| 92 | G1133 | HLH/MYC | 301–315 | protein |
| 93 | G1134 | HLH/MYC | 1–100, 30–45, 75–125, 150–200, 200–300, 350–400 | cDNA |
| 94 | G1134 | HLH/MYC | 229–243 | protein |
| 95 | G1664 | HLH/MYC | 1–100, 30–45, 75–125, 150–200, 200–300, 350–400 | cDNA |
| 96 | G1664 | HLH/MYC | 291–319 | protein |
| 97 | G447 | IAA/AUX | 1–100, 30–45, 75–125, 150–200, 200–300, 350–400 | cDNA |
| 98 | G447 | IAA/AUX | 22–356, 866–955 | protein |
| 99 | G467 | IAA/AUX | 1–100, 30–45, 75–125, 150–200, 200–300, 350–400 | cDNA |
| 100 | G467 | IAA/AUX | aa 43–50, 93–109, 151–184, 213–247 | protein |
| 101 | G716 | IAA/AUX | 1–100, 30–45, 75–125, 150–200, 200–300, 350–400 | cDNA |
| 102 | G716 | IAA/AUX | 24–356, 866–955 | protein |
| 103 | G991 | IAA/AUX | 1–100, 30–45, 75–125, 150–200, 200–300, 350–400 | cDNA |
| 104 | G991 | IAA/AUX | 8–14, 49–61, 82–115, 131–160 | protein |
| 105 | G1267 | WRKY | 1–100, 30–45, 75–125, 150–200, 200–300, 350–400 | cDNA |
| 106 | G1267 | WRKY | 70–127 | protein |
| 107 | G1025 | MISC | 1–100, 30–45, 75–125, 150–200, 200–300, 350–400 | cDNA |
| 108 | G1025 | MISC | 1267–1294 | protein |
| 109 | G1212 | MISC | 1–100, 30–45, 75–125, 150–200, 200–300, 350–400 | cDNA |
| 110 | G1212 | MISC | 110–129 | protein |
| 111 | G1219 | MISC | 1–100, 30–45, 75–125, 150–200, 200–300, 350–400 | cDNA |
| 112 | G1219 | MISC | 57–79, 158–183, 281–308, 366–393 | protein |
| 113 | G1228 | MISC | 1–100, 30–45, 75–125, 150–200, 200–300, 350–400 | cDNA |
| 114 | G1228 | MISC | 176–192 | protein |
| 115 | G1232 | MISC | 1–100, 30–45, 75–125, 150–200, 200–300, 350–400 | cDNA |
| 116 | G1232 | MISC | aa 46–102 | protein |
| 117 | G1233 | MISC | 1–100, 30–45, 75–125, 150–200, 200–300, 350–400 | cDNA |
| 118 | G1233 | MISC | aa 47–103 | protein |
| 119 | G1236 | MISC | 1–100, 30–45, 75–125, 150–200, 200–300, 350–400 | cDNA |
| 120 | G1236 | MISC | | protein |

TABLE 1-continued

| SEQ ID NO. | GID No. | Family | Fragments | cDNA or protein |
|---|---|---|---|---|
| 121 | G1240 | MISC | 1–100, 30–45, 75–125, 150–200, 200–300, 350–400 | cDNA |
| 122 | G1240 | MISC | | protein |
| 123 | G1242 | MISC | 1–100, 30–45, 75–125, 150–200, 200–300, 350–400 | cDNA |
| 124 | G1242 | MISC | 132–150 | protein |
| 125 | G1243 | MISC | 1–100, 30–45, 75–125, 150–200, 200–300, 350–400 | cDNA |
| 126 | G1243 | MISC | | protein |
| 127 | G1300 | MISC | 1–100, 30–45, 75–125, 150–200, 200–300, 350–400 | cDNA |
| 128 | G1300 | MISC | 47–103 | protein |
| 129 | G1322 | MYB | 1–100, 30–45, 75–125, 150–200, 200–300, 350–400 | cDNA |
| 130 | G1322 | MYB | 25–97 | protein |
| 131 | G1318 | MYB | 1–100; 30–45, 75–125, 150–200, 200–300, 350–400 | cDNA |
| 132 | G1318 | MYB | 18–122 | protein |
| 133 | G1326 | MYB | 1–100, 30–45, 75–125, 150–200, 200–300, 350–400 | cDNA |
| 134 | G1326 | MYB | 17–121 | protein |
| 135 | G1269 | MYB | 1–100, 30–45, 75–125, 150–200, 200–300, 350–400 | cDNA |
| 136 | G1269 | MYB | 25–113 | protein |
| 137 | G1308 | MYB | 1–100, 30–45, 75–125, 150–200, 200–300, 350–400 | cDNA |
| 138 | G1308 | MYB | 12–115 | protein |
| 139 | G1311 | MYB | 1–100, 30–45, 75–125, 150–200, 200–300, 350–400 | cDNA |
| 140 | G1311 | MYB | 9–112 | protein |
| 141 | G1313 | MYB | 1–100, 30–45, 75–125, 150–200, 200–300, 350–400 | cDNA |
| 142 | G1313 | MYB | 23–146 | protein |
| 143 | G1314 | MYB | 1–100, 30–45, 75–125, 150–200, 200–300, 350–400 | cDNA |
| 144 | G1314 | MYB | 12–116 | protein |
| 145 | G1315 | MYB | 1–100, 30–45, 75–125, 150–200, 200–300, 350–400 | cDNA |
| 146 | G1315 | MYB | 12–116 | protein |
| 147 | G1317 | MYB | 1–100, 30–45, 75–125, 150–200, 200–300, 350–400 | cDNA |
| 148 | G1317 | MYB | 12–116 | protein |
| 149 | G1319 | MYB | 1–100, 30–45, 75–125, 150–200, 200–300, 350–400 | cDNA |
| 150 | G1319 | MYB | 12–116 | protein |
| 151 | G1324 | MYB | 1–100, 30–45, 75–125, 150–200, 200–300, 350–400 | cDNA |
| 152 | G1324 | MYB | 19–122 | protein |
| 153 | G1325 | MYB | 1–100, 30–45, 75–125, 150–200, 200–300, 350–400 | cDNA |
| 154 | G1325 | MYB | 41–104 | protein |
| 155 | G1327 | MYB | 1–100, 30–45, 75–125, 150–200, 200–300, 350–400 | cDNA |
| 156 | G1327 | MYB | 7 . . . 78 | protein |
| 157 | G1362 | MYB | 1–100, 30–45, 75–125, 150–200, 200–300, 350–400 | cDNA |
| 158 | G1362 | MYB | 117–281 | protein |
| 159 | G665 | MYB | 1–100, 30–45, 75–125, 150–200, 200–300, 350–400 | cDNA |
| 160 | G665 | MYB | 87–141 | protein |
| 161 | G682 | MYB | 1–100, 30–45, 75–125, 150–200, 200–300, 350–400 | cDNA |
| 162 | G682 | MYB | 22–53 | protein |
| 163 | G998 | MYB | 1–100, 30–45, 75–125, 150–200, 200–300, 350–400 | cDNA |
| 164 | G998 | MYB | 27–103 | protein |
| 165 | G759 | NAM | 1–100, 30–45, 75–125, 150–200, 200–300, 350–400 | cDNA |
| 166 | G759 | NAM | 14–162 | protein |
| 167 | G760 | NAM | 1–100, 30–45, 75–125, 150–200, 200–300, 350–400 | cDNA |
| 168 | G760 | NAM | 9–159 | protein |
| 169 | G764 | NAM | 1–100, 30–45, 75–125, 150–200, 200–300, 350–400 | cDNA |
| 170 | G764 | NAM | 24–172 | protein |
| 171 | G765 | NAM | 1–100, 30–45, 75–125, 150–200, 200–300, 350–400 | cDNA |
| 172 | G765 | NAM | 20–171 | protein |
| 173 | G1426 | NAM | 1–100, 30–45, 75–125, 150–200, 200–300, 350–400 | cDNA |
| 174 | G1426 | NAM | 4–155 | protein |
| 175 | G1425 | NAM | 1–100, 30–45, 75–125, 150–200, 200–300, 350–400 | cDNA |
| 176 | G1425 | NAM | 17–177 | protein |
| 177 | G1412 | NAM | 1–100, 30–45, 75–125, 150–200, 200–300, 350–400 | cDNA |
| 178 | G1412 | NAM | 14–162 | protein |
| 179 | G746 | RING C3HC4 | 1–100, 30–45, 75–125, 150–200, 200–300, 350–400 | cDNA |
| 180 | G746 | RING C3HC4 | 139–178 | protein |
| 181 | G752 | RING C3H2C3 | 1–100, 30–45, 75–125, 150–200, 200–300, 350–400 | cDNA |
| 182 | G752 | RING C3H2C3 | 448–490 | protein |
| 183 | G1395 | S1FA | 1–100, 30–45, 75–125, 150–200, 200–300, 350–400 | cDNA |
| 184 | G1395 | S1FA | 41 . . . 55 | protein |
| 185 | G477 | SPBP | 1–100, 30–45, 75–125, 150–200, 200–300, 350–400 | cDNA |
| 186 | G477 | SPBP | 131–197 | protein |
| 187 | G1552 | SPBP | 1–100, 30–45, 75–125, 150–200, 200–300, 350–400 | cDNA |
| 188 | G1552 | SPBP | 116–175 | protein |
| 189 | G636 | TH | 1–100, 30–45, 75–125, 150–200, 200–300, 350–400 | cDNA |
| 190 | G636 | TH | 67–97 | protein |
| 191 | G638 | TH | 1–100, 30–45, 75–125, 150–200, 200–300, 350–400 | cDNA |
| 192 | G638 | TH | 146–176 | protein |

TABLE 1-continued

| SEQ ID NO. | GID No. | Family | Fragments | cDNA or protein |
|---|---|---|---|---|
| 193 | G639 | TH | 1–100, 30–45, 75–125, 150–200, 200–300, 350–400 | cDNA |
| 194 | G639 | TH | 329–359 | protein |
| 195 | G640 | TH | 1–100, 30–45, 75–125, 150–200, 200–300, 350–400 | cDNA |
| 196 | G640 | TH | 500–530 | protein |
| 197 | G1382 | WRKY | 1–100, 30–45, 75–125, 150–200, 200–300, 350–400 | cDNA |
| 198 | G1382 | WRKY | 211–266, 381–437 | protein |
| 199 | G1669 | Z | 1–100, 30–45, 75–125, 150–200, 200–300, 350–400 | cDNA |
| 200 | G1669 | Z | 22–62 | protein |
| 201 | G901 | Z | 1–100, 30–45, 75–125, 150–200, 200–300, 350–400 | cDNA |
| 202 | G901 | Z | 5–99 | protein |
| 203 | G903 | Z | 1–100, 30–45, 75–125, 150–200, 200–300, 350–400 | cDNA |
| 204 | G903 | Z | 80–100 | protein |
| 205 | G2119 | RING C3HC4 | 1–100, 30–45, 75–125, 150–200, 200–300, 350–400 | cDNA |
| 206 | G2119 | RING C3HC4 | 134–177 | protein |
| 207 | G2120 | kinase | 1–100, 30–45, 75–125, 150–200, 200–300, 350–400 | cDNA |
| 208 | G2120 | kinase | 410–554, 587–624 | protein |

The identified polypeptide fragments may be combined with fragments or sequences derived from other transcription factors so as to generate additional novel sequences, such as by employing the methods described in Short, PCT publication WO9827230, entitled "Methods and Compositions for Polypeptide Engineering" or in Patten et al., PCT publication WO9923236, entitled "Method of DNA Shuffling".

The isolated polynucleotides and polypeptides may be used to modify plant development, physiology or biochemistry such that modified plants have a trait advantage over wild type plants. The identified polynucleotide fragments are also useful as nucleic acid probes and primers. A nucleic acid probe is useful in hybridization protocols, including protocols for microarray experiments. Primers may be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook et al., *Molecular Cloning. A Laboratory Manual*, Ed. 2, Cold Spring Harbor Laboratory Press, New York (1989) and Ausubel et al. (eds) *Current Protocols in Molecular Biology*, John Wiley & Sons (1998).

2. Identification of Homologous Sequences (Homologs)

Homologous sequences to those provided in the Sequence Listing derived from *Arabidopsis thaliana* or from other plants may be used to modify a plant trait. Homologous sequences may be derived from any plant including monocots and dicots and in particular agriculturally important plant species, including but not limited to, crops such as soybean, wheat, corn, potato, cotton, rice, oilseed rape (including canola), sunflower, alfalfa, sugarcane and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, spinach, squash, sweet corn, tobacco, tomato, watermelon, rosaceous fruits (such as apple, peach, pear, cherry and plum) and vegetable brassicas (such as broccoli, cabbage, cauliflower, brussel sprouts and kohlrabi). Other crops, fruits and vegetables whose phenotype may be changed include barley, currant, avocado, citrus fruits such as oranges, lemons grapefruit and tangerines, artichoke, cherries, nuts such as the walnut and peanut, endive, leek, roots, such as arrowroot, beet, cassava, turnip, radish, yam, sweet potato and beans. The homologs may also be derived from woody species, such pine, poplar and eucalyptus.

Substitutions, deletions and insertions introduced into the sequences provided in the Sequence Listing are also envisioned by the invention. Such sequence modifications can be engineered into a sequence by site-directed mutagenesis (Wu (ed.) *Meth. Enzymol.* (1993) vol.217, Academic Press). Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof may be combined to arrive at a sequence. The mutations that are made in the polynucleotide encoding the transcription factor should not place the sequence out of reading frame and should not create complementary regions that could produce secondary mRNA structure.

Substitutions are those in which at least one residue in the amino acid sequence has been removed and a different residue inserted in its place. Such substitutions generally are made in accordance with the following Table 2 when it is desired to maintain the activity of the protein. Table 2 shows amino acids which may be substituted for an amino acid in a protein and which are typically regarded as conservative substitutions.

TABLE 2

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |

TABLE 2-continued

| Residue | Conservative Substitutions |
|---|---|
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Substitutions that are less conservative than those in Table 2 may be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Additionally, the term "homologous sequence" may encompass a polypeptide sequence that is modified by chemical or enzymatic means. The homologous sequence may be a sequence modified by lipids, sugars, peptides, organic or inorganic compounds, by the use of modified amino acids or the like. Protein modification techniques are illustrated in Ausubel et al. (eds) *Current Protocols in Molecular Biology*, John Wiley & Sons (1998).

Homologous sequences also may mean two sequences having a substantial percentage of sequence identity after alignment as determined by using sequence analysis programs for database searching and sequence alignment and comparison available, for example, from the Wisconsin Package Version 10.0, such as BLAST, FASTA, PILEUP, FINDPATTERNS or the like (GCG, Madision, Wis.). Public sequence databases such as GenBank, EMBL, Swiss-Prot and PIR or private sequence databases such as PhytoSeq (Incyte Genomics, Palo Alto, Calif.) may be searched. Alignment of sequences for comparison may be conducted by the local homology algorithm of Smith and Waterman (1981) *Adv. Appl. Math.* 2:482, by the homology alignment algorithm of Needleman and Wunsch (1970) *J. Mol. Biol.* 48:443, by the search for similarity method of Pearson and Lipman (1988) *Proc. Natl. Acad. Sci. U.S.A.* 85: 2444, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window may be a segment of at least about 20 contiguous positions, usually about 50 to about 200, more usually about 100 to about 150 contiguous positions. A description of the method is provided in Ausubel et al. (eds) (1999) *Current Protocols in Molecular Biology*, John Wiley & Sons.

Transcription factors that are homologs of the disclosed sequences will typically share at least 40% amino acid sequence identity. More closely related TFs may share at least 50%, 60%, 65%, 70%, 75% or 80% sequence identity with the disclosed sequences. Factors that are most closely related to the disclosed sequences share at least 85%, 90% or 95% sequence identity. At the nucleotide level, the sequences will typically share at least 40% nucleotide sequence identity, preferably at least 50%, 60%, 70% or 80% sequence identity, and more preferably 85%, 90%, 95% or 97% sequence identity. The degeneracy of the genetic code enables major variations in the nucleotide sequence of a polynucleotide while maintaining the amino acid sequence of the encoded protein.

One way to identify whether two nucleic acid molecules are closely related is that the two molecules hybridize to each other under stringent conditions. Generally, stringent conditions are selected to be about 5° C. to 20° C. lower than the thermal melting point (Tm) for the specific sequence at a defined ionic strength and pH. The $T_m$ is the temperature (under defined ionic strength and pH) at which 50% of the target sequence hybridizes to a perfectly matched probe. Conditions for nucleic acid hybridization and calculation of stringencies can be found in Sambrook et al. (1989) *Molecular Cloning. A Laboratory Manual*, Ed. 2, Cold Spring Harbor Laboratory Press, New York and Tijssen (1993) *Laboratory Techniques in Biochemistry and Molecular Biology—Hybridization with Nucleic Acid Probes* Part I, Elsevier, New York. Nucleic acid molecules that hybridize under stringent conditions will typically hybridize to a probe based on either the entire cDNA or selected portions of the cDNA under wash conditions of 0.2×SSC to 2.0×SSC, 0.1% SDS at 50–65° C., for example 0.2×SSC, 0.1% SDS at 65° C. For detecting less closely related homologs washes may be performed at 50° C.

For conventional hybridization the hybridization probe is conjugated with a detectable label such as a radioactive label, and the probe is preferably of at least 20 nucleotides in length. As is well known in the art, increasing the length of hybridization probes tends to give enhanced specificity. The labeled probe derived from the *Arabidopsis* nucleotide sequence may be hybridized to a plant cDNA or genomic library and the hybridization signal detected using means known in the art. The hybridizing colony or plaque (depending on the type of library used) is then purified and the cloned sequence contained in that colony or plaque isolated and characterized. Homologs may also be identified by PCR-based techniques, such as inverse PCR or RACE, using degenerate primers. See Ausubel et al. (eds) (1998) *Current Protocols in Molecular Biology*, John Wiley & Sons.

TF homologs may alternatively be obtained by immunoscreening an expression library. With the provision herein of the disclosed TF nucleic acid sequences, the polypeptide may be expressed and purified in a heterologous expression system (e.g., *E. coli*) and used to raise antibodies (monoclonal or polyclonal) specific for the TF. Antibodies may also be raised against synthetic peptides derived from TF amino acid sequences. Methods of raising antibodies are well known in the art and are described in Harlow and Lane (1988) *Antibodies: A Laboratory Manual*, Cold Spring Harbor Laboratory, New York. Such antibodies can then be used to screen an expression library produced from the plant from which it is desired to clone the TF homolog, using the methods described above. The selected cDNAs may be confirmed by sequencing and enzymatic activity.

3. Ectopic Expression of Transcription Factors

Any of the identified sequences may be incorporated into a cassette or vector for expression in plants. A number of expression vectors suitable for stable transformation of plant cells or for the establishment of transgenic plants have been described including those described in Weissbach and Weissbach, (1989) *Methods for Plant Molecular Biology*, Academic Press, and Gelvin et al., (1990) *Plant Molecular Biology Manual*, Kluwer Academic Publishers. Specific examples include those derived from a Ti plasmid of *Agrobacterium tumefaciens*, as well as those disclosed by Herrera-Estrella, L., et al., (1983) *Nature* 303: 209, Bevan, M., *Nucl. Acids Res.* (1984) 12: 8711–8721, Klee, H. J., (1985) *Bio/Technology* 3: 637–642, for dicotyledonous plants.

Alternatively, non-Ti vectors can be used to transfer the DNA into monocotyledonous plants and cells by using free DNA delivery techniques. Such methods may involve, for example, the use of liposomes, electroporation, microprojectile bombardment, silicon carbide wiskers, and viruses. By using these methods transgenic plants such as wheat, rice (Christou, P., (1991) *Bio/Technology* 9: 957–962) and corn (Gordon-Kamm, W., (1990) *Plant Cell* 2: 603–618) can be produced. An immature embryo can also be a good target tissue for direct DNA delivery techniques by using the particle gun (Weeks, T. et al., (1993) *Plant Physiol.* 102: 1077–1084; Vasil, V., (1993) *Bio/Technology* 10: 667–674; Wan, Y. and Lemeaux, P., (1994) *Plant Physiol.* 104: 37–48, and for *Agrobacterium*-mediated DNA transfer (Ishida et al., (1996) *Nature Biotech.* 14: 745–750).

Typically, plant transformation vectors include one or more cloned plant coding sequences (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

Examples of constitutive plant promoters which may be useful for expressing the TF sequence include: the cauliflower mosaic virus (CaMV) 35S promoter, which confers constitutive, high-level expression in most plant tissues (see, e.g., Odell et al., (1985) Nature 313:810–812); the nopaline synthase promoter (An et al., (1988) *Plant Physiol.* 88:547); and the octopine synthase promoter (Fromm et al., (1989) *Plant Cell* 1: 977–984).

A variety of plant gene promoters that regulate gene expression in response to environmental, hormonal, chemical, developmental signals, and in a tissue-active manner can be used for expression of the TF sequence in plants, as illustrated seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol. Biol.* 11:651), root-specific promoters, such as those disclosed in U.S. Pat. Nos. 5,618,988, 5,837, 848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37:977–988), flower-specific (Kaiser et al, (1995) *Plant Mol. Biol.* 28:231–243), pollen (Baerson et al. (1994) *Plant Mol. Biol.* 26:1947–1959), carpels (Ohl et al. (1990) *Plant Cell* 2:837–848), pollen and ovules (Baerson et al. (1993) *Plant Mol. Biol.* 22:255–267), auxin-inducible promoters (such as that described in van der Kop et al (1999) *Plant Mol. Biol.* 39:979–990 or Baumann et al. (1999) *Plant Cell* 11:323–334), cytokinin-inducible promoter (Guevara-Garcia (1998) *Plant Mol. Biol.* 38:743–753), promoters responsive to gibberellin (Shi et al. (1998) *Plant Mol. Biol.* 38:1053–1060, Willmott et al. (1998) 38:817–825) and the like. Additional promoters are those that elicit expression in response to heat (Ainley, et al. (1993) *Plant Mol. Biol.* 22: 13–23), light (e.g., the pea rbcS-3A promoter, Kuhlemeier et al., (1989) *Plant Cell* 1:471–478, and the maize rbcS promoter, Schaffner and Sheen, (1991) *Plant Cell* 3: 997–1012); wounding (e.g., wunI, Siebertz et al., (1989) *Plant Cell* 1: 961–968); pathogen resistance, and chemicals such as methyl jasmonate or salicylic acid (Gatz et al., (1997) *Annu Rev. Plant Physiol. Plant Mol. Biol.* 48: 89–108). In addition, the timing of the expression can be controlled by using promoters such as those acting at senescence (An and Amazon (1995) *Science* 270: 1986–1988); or late seed development (Odell et al. (1994) *Plant Physiol.* 106:447–458).

Plant expression vectors may also include RNA processing signals that may be positioned within, upstream or downstream of the coding sequence. In addition, the expression vectors may include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Finally, as noted above, plant expression vectors may also include dominant selectable marker genes to allow for the ready selection of transformants. Such genes include those encoding antibiotic resistance genes (e.g., resistance to hygromycin, kanamycin, bleomycin, G418, streptomycin or spectinomycin) and herbicide resistance genes (e.g., phosphinothricin acetyltransferase).

A reduction of TF expression in a transgenic plant to modifiy a plant trait may be obtained by introducing into plants antisense constructs based on the TF cDNA. For antisense suppression, the TF cDNA is arranged in reverse orientation relative to the promoter sequence in the expression vector. The introduced sequence need not be the full length TF cDNA or gene, and need not be identical to the TF cDNA or a gene found in the plant type to be transformed. Generally, however, where the introduced sequence is of shorter length, a higher degree of homology to the native TF sequence will be needed for effective antisense suppression. Preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous TF gene in the plant cell. Suppression of endogenous TF gene expression can also be achieved using a ribozyme. Ribozymes are synthetic RNA molecules that possess highly specific endoribonuclease activity. The production and use of ribozymes are disclosed in U.S. Pat. No. 4,987,071 to Cech and U.S. Pat. No. 5,543,508 to Haselhoff. The inclusion of ribozyme sequences within antisense RNAs may be used to confer RNA cleaving activity on the antisense RNA, such that endogenous mRNA molecules that bind to the antisense RNA are cleaved, which in turn leads to an enhanced antisense inhibition of endogenous gene expression.

Vectors in which RNA encoded by the TF cDNA (or variants thereof) is over-expressed may also be used to obtain co-suppression of the endogenous TF gene in the manner described in U.S. Pat. No. 5,231,020 to Jorgensen. Such co-suppression (also termed sense suppression) does not require that the entire TF cDNA be introduced into the plant cells, nor does it require that the introduced sequence be exactly identical to the endogenous TF gene. However, as with antisense suppression, the suppressive efficiency will be enhanced as (1) the introduced sequence is lengthened and (2) the sequence similarity between the introduced sequence and the endogenous TF gene is increased.

Vectors expressing an untranslatable form of the TF mRNA may also be used to suppress the expression of endogenous TF activity to modify a trait. Methods for producing such constructs are described in U.S. Pat. No. 5,583,021 to Dougherty et al. Preferably, such constructs are made by introducing a premature stop codon into the TF gene. Alternatively, a plant trait may be modified by gene silencing using double-strand RNA (Sharp (1999) *Genes and Development* 13: 139–141).

Another method for abolishing the expression of a gene is by insertion mutagenesis using the T-DNA of *Agrobacterium tumefaciens*. After generating the insertion mutants, the mutants can be screened to identify those containing the insertion in a TF gene. Mutants containing a single mutation event at the desired gene may be crossed to generate homozygous plants for the mutation (Koncz et al. (1992) *Methods in Arabidopsis Research.* World Scientific).

A plant trait may also be modified by using the cre-lox system (for example, as described in U.S. Pat. No. 5,658, 772). A plant genome may be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention may also be expressed in a plant in the absence of an expression cassette by manipulating the activity or expression level of the endogenous gene by other means. For example, by ectopically expressing a gene by T-DNA activation tagging (Ichikawa et al., (1997) *Nature* 390 698–701, Kakimoto et al., (1996) *Science* 274: 982–985). This method entails transforming a plant with a gene tag containing multiple transcriptional enhancers and once the tag has inserted into the genome, expression of a flanking gene coding sequence becomes deregulated. In another example, the transcriptional machinery in a plant may be modified so as to increase transcription levels of a polynucleotide of the invention (See PCT Publications WO9606166 and WO 9853057 which describe the modification of the DNA binding specificity of zinc finger proteins by changing particular amino acids in the DNA binding motif). The transgenic plant may also comprise the machinery necessary for expressing or altering the activity of a polypeptide encoded by an endogenous gene, for example by altering the phosphorylation state of the polypeptide to maintain it in an activated state.

4. Transgenic Plants with Modified TF Expression

Once an expression cassette comprising a polynucleotide encoding a TF gene of this invention has been constructed, standard techniques may be used to introduce the polynucleotide into a plant in order to modify a trait of the plant. The plant may be any higher plant, including gymnosperms, monocotyledonous and dicotyledenous plants. Suitable protocols are available for *Leguminosae* (alfalfa, soybean, clover, etc.), *Umbelliferae* (carrot, celery, parsnip), *Cruciferae* (cabbage, radish, rapeseed, broccoli, etc.), *Curcurbitaceae* (melons and cucumber), *Gramineae* (wheat, corn, rice, barley, millet, etc.), *Solanaceae* (potato, tomato, tobacco, peppers, etc.), and various other crops. See protocols described in Ammirato et al. (1984) *Handbook of Plant Cell Culture—Crop Species.* Macmillan Publ. Co. Shimamoto et al. (1989) *Nature* 338:274–276; Fromm et al. (1990) *Bio/Technology* 8:833–839; and Vasil et al. (1990) *Bio/Technology* 8:429–434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods may include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumeficiens* mediated transformation. Transformation means introducing a nucleotide sequence in a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait may be any of those traits described above. Additionally, to confirm that the modified trait is due to changes in expression levels or activity of the polypeptide or polynucleotide of the invention may be determined by analyzing mRNA expression using Northern blots, RT-PCR or microarrays, or protein expression using immunoblots or Western blots or gel shift assays.

5. Other Utility of the Polypeptide and Polynucleotide Sequences

A transcription factor provided by the present invention may also be used to identify exogenous or endogenous molecules that may affect expression of the transcription factors and may affect any of the traits described herein. These molecules may include organic or inorganic compounds.

For example, the method may entail first placing the molecule in contact with a plant or plant cell. The molecule may be introduced by topical administration, such as spraying or soaking of a plant, and then the molecule's effect on the expression or activity of the TF polypeptide or the expression of the polynucleotide monitored. Changes in the expression of the TF polypeptide may be monitored by use of polyclonal or monoclonal antibodies, gel electrophoresis or the like. Changes in the expression of the corresponding polynucleotide sequence may be detected by use of microarrays, Northerns or any other technique for monitoring changes in mRNA expression. These techniques are exemplified in Ausubel et al. (eds) *Current Protocols in Molecular Biology*, John Wiley & Sons (1998). Such changes in the expression levels may be correlated with modified plant traits and thus identified molecules may be useful for soaking or spraying on fruit, vegetable and grain crops to modify traits in plants.

The transcription factors may also be employed to identify promoter sequences with which they may interact. After identifying a promoter sequence, interactions between the transcription factor and the promoter sequence may be modified by changing specific nucleotides in the promoter sequence or specific amino acids in the transcription factor that interact with the promoter sequence to alter a plant trait. Typically, transcription factor DNA binding sites are identified by gel shift assays. After identifying the promoter regions, the promoter region sequences may be employed in double-stranded DNA arrays to identify molecules that affect the interactions of the TFs with their promoters (Bulyk et al. (1999) *Nature Biotechnology* 17:573–577).

The identified transcription factors are also useful to identify proteins that modify the activity of the transcription factor. Such modification may occur by covalent modification, such as by phosphorylation, or by protein-protein (homo or- heteropolymer) interactions. Any method suitable for detecting protein-protein interactions may be employed. Among the methods that may be employed are co-immunoprecipitation, cross-linking and co-purification through gradients or chromatographic columns, and the two-hybrid yeast system.

The two-hybrid system detects protein interactions in vivo and is described in Chien, et al., (1991), *Proc. Natl. Acad. Sci. USA*, 88, 9578–9582 and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions may be preformed.

The following examples are intended to illustrate but not limit the present invention.

EXAMPLE I

Full Length Gene Identification and Cloning

Putative transcription factor sequences (genomic or ESTs) related to known transcription factors were identified in the *Arabidopsis thaliana* GenBank database using the tblastn sequence analysis program using default parameters and a P-value cutoff threshold of –4 or –5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$p dCTP using the High Prime DNA Labeling Kit (Boehringer Mannheim). Purified radiolabelled probes were added to filters immersed in Church hybridization medium (0.5 M NaPO$_4$ pH 7.0, 7% SDS 1% w/v bovine serum albumin) and hybridized overnight at 60° C. with shaking. Filters were washed two times for 45 to 60 minutes with 1×SCC, 1% SDS at 60° C.

As an example, the following GID Nos. may be screened with the primers found in Table 3.

TABLE 3

| GID No. | SEQ ID NO: | Forward primer | SEQ ID NO: | Reverse Primer | SEQ ID NO: |
|---|---|---|---|---|---|
| G1090 | 11 | CGTTAACCAGTTGTCCTACAGAGGCATTCG | 209 | CGGAGACAATCCTACTCGAGAAAGTCCTTG | 210 |
| G732 | 31 | GCGTCATCTAGCAGCACATACCGGAG | 211 | ATATCATCGTAATATCCGTCGATCCCAACC | 212 |
| G467 | 99 | TCCTAATGGAGGGTTATTCAAGAAACGGTG | 213 | TGAGATCAACTTTACGACCAATGGGAACAC | 214 |
| G665 | 159 | CCTCCTCTTCCTCTTCCTTTGCTGGTTATC | 215 | TAATCCAATTAGAAACGTCCGGTGCTCTTC | 216 |
| G682 | 161 | AAACCTCTCAATTTCTCCAGCGGTTCTTC | 217 | AGGACTAAGCAACCCAAGACCAACTCCATC | 218 |

To identify additional sequence 5' or 3' of a partial cDNA sequence in a cDNA library, 5' and 3' rapid amplification of cDNA ends (RACE) was performed using the Marathon™ cDNA amplification kit (Clontech Palo Alto, Calif.). Generally, the method entailed first isolating poly(A) mRNA, performing first and second strand cDNA synthesis to generate double stranded cDNA, blunting cDNA ends, followed by ligation of the Marathon™ Adaptor to the cDNA to form a library of adaptor-ligated ds cDNA. Gene-specific primers were designed to be used along with adaptor specific primers for both 5' and 3' RACE reactions. Nested primers, rather than single primers, were used to increase PCR specificity.

Using 5' and 3' RACE reactions, 5' and 3' RACE fragments were obtained, sequenced and cloned. The process may be repeated until 5' and 3' ends of the full-length gene were identified. Then the full-length cDNA was generated by PCR using primers specific to 5' and 3' ends of the gene by end-to-end PCR.

EXAMPLE II

Construction of Expression Vectors

The sequence was amplified from a genomic or cDNA library using primers specific to sequences upstream and downstream of the coding region. The expression vector was pMEN20, which is derived from pMON316 (Sanders et al, (1987) *Nucleic Acids Research* 15:1543–58). To clone the sequence into the vector, both pMEN20 and the genomic sequence clone were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a QIAquick gel extraction kit (Qiagen, Carlsbad, Calif.). The fragments of interest were ligated at a ratio of 3:1 (vector to insert). Ligation reactions using T4 DNA ligase (New England Biolabs, Massachusetts) were carried out at 16° C. for 16 hours. The ligated DNAs were transformed into competent cells of the *E. coli* strain DH5alpha by using the heat shock method. The transformations were plated on LB plates containing 50 mg/l spectinomycin (Sigma).

Individual colonies were grown overnight in five milliliters of LB broth containing 50 mg/l spectinomycin at 37° C. Plasmid DNA was purified by using QIAquick mini prep kits (Qiagen).

EXAMPLE III

Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation were made as described by Nagel et al. *FEMS Microbiol Letts* 67: 325–328 (1990). *Agrobacterium* strain GV3101 was grown in 250 ml LB medium (Sigma) overnight at 28° C. with shaking until an absorbance ($A_{600}$) of 0.5–1.0 was reached. Cells were harvested by centrifugation at 4,000×g for 15 min at 4° C. Cells were then resuspended in 250 μl chilled buffer (1 mM HEPES, pH adjusted to 7.0 with KOH). Cells were centrifuged again as described above and resuspended in 125 μl chilled buffer. Cells were then centrifuged and resuspended two more times in the same HEPES buffer as described above at a volume of 100 μl and 750 μl, respectively. Resuspended cells were then distributed into 40 μl aliquots, quickly frozen in liquid nitrogen, and stored at −80° C.

*Agrobacterium* cells were transformed with plasmids prepared as described above following the protocol described by Nagel et al. *FEMS Microbiol Letts* 67: 325–328 (1990). For each DNA construct to be transformed, 50–100 ng DNA (generally resuspended in 10 mM Tris-HCl, 1 mM EDTA, pH 8.0) was mixed with 40 μl of *Agrobacterium* cells. The DNA/cell mixture was then transferred to a chilled cuvette with a 2 mm electrode gap and subject to a 2.5 kV charge dissipated at 25 μF and 200 μF using a Gene Pulser II apparatus (Bio-Rad). After electroporation, cells were immediately resuspended in 1.0 ml LB and allowed to recover without antibiotic selection for 2–4 hours at 28° C. in a shaking incubator. After recovery, cells were plated onto selective medium of LB broth containing 100 μg/ml spectinomycin (Sigma) and incubated for 24–48 hours at 28° C. Single colonies were then picked and inoculated in fresh medium. The presence of the plasmid construct was verified by PCR amplification and sequence analysis.

EXAMPLE IV

Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l spectinomycin were inoculated with the colonies and grown at 28° C. with shaking for 2 days until an absorbance ($A_{600}$) of >2.0 is reached. Cells were then harvested by centrifugation at 4,000×g for 10 min, and resuspended in infiltration medium (1/2× Murashige and Skoog salts (Sigma), 1× Gamborg's B-5 vitamins (Sigma), 5.0% (w/v) sucrose (Sigma), 0.044 μM benzylamino purine (Sigma), 200 μl/L Silwet L-77 (Lehle Seeds) until an absorbance ($A_{600}$) of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm). Plants were grown under continuous illumination (50–75 μE/m²/sec) at 22–23° C. with 65–70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

EXAMPLE V

Identification of *Arabidopsis* Primary Transformants

Seeds collected from the transformation pots were sterilized essentially as follows. Seeds were dispersed into in a solution containing 0.1% (v/v) Triton X-100 (Sigma) and sterile $H_2O$ and washed by shaking the suspension for 20 min. The wash solution was then drained and replaced with fresh wash solution to wash the seeds for 20 min with shaking. After removal of the second wash solution, a solution containing 0.1% (v/v) Triton X-100 and 70% ethanol (Equistar) was added to the seeds and the suspension was shaken for 5 min. After removal of the ethanol/detergent solution, a solution containing 0.1% (v/v) Triton X-100 and 30% (v/v) bleach (CLOROX, Clorox Co Oakland, Calif.) was added to the seeds, and the suspension was shaken for 10 min. After removal of the bleach/detergent solution, seeds were then washed five times in sterile distilled H$_2$O. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50–75 µE/m$^2$/sec) at 22–23° C. After 7–10 days of growth under these conditions, kanamycin resistant primary transformants (T$_1$ generation) were visible and obtained. These seedlings were transferred first to fresh selection plates where the seedlings continued to grow for 3–5 more days, and then to soil (Pro-Mix BX potting medium).

Primary transformants are self-crossed and progeny seeds (T2) collected.

EXAMPLE VI

Analysis of *Arabidopsis* T2 Progeny Plants

T2 progeny seeds were germinated on kanamycin as described above and kanamycin resistant seedlings were selected, transferred to soil and analyzed. In one analysis, lipids were extracted and trans-esterified from 1 cm$^2$ sections of leaves of T2 progeny plants with 1 mL of 2.5% sulphuric acid in methanol and heated to 80° C. for one hour. 0.3 mL of hexane was added to the extracts followed by 1 mL of 0.9% sodium chloride and the esterified lipids were partitioned into the hexane layer by centrifugation at 2000 rpm for 2 minutes. This purified extract was subjected to gas liquid chromatography on a Hewlett-Packard 6890 dual FID gas chromatograph using a Supelco SP-2330 column (30 m×250 um×0.20 um) with an oven temperature initially set at 100° C. for 1 min followed by two gradient ramps of 25° C./min to 160° C. and 10° C./min to 220° C. Using these methods T2 plants containing the G467 (SEQ ID NO: 99) and G1090 (SEQ ID NO: 11) constructs were shown to have up to 50% more of certain fatty acids in leaves compared to controls. Therefore, G467 (SEQ ID NO: 99 and polypeptide SEQ ID NO: 100) and G1090 (SEQ ID NO: 11 and polypeptide SEQ ID NO: 12) can be used to increase or decrease the amounts of, or modify the composition of, specialty or edible oils in plant species, particularly in oilseed crops.

In another analysis to measure altered pathogen tolerance or resistance, leaves of four-to five week old T2 progeny plants were inoculated with conidia using a camel's hair paintbrush from a 10 to 14 day old culture of a fungal pathogen *Erysiphe orontii*. At 14–21 days after inoculation, plants were examined for the development of disease symptoms. Plants expressing the G665 (SEQ ID NO: 159) construct were more chlorotic and fewer fungal conidia developed on the leaf surface of the plants compared to controls. Therefore G665 (SEQ ID NO: 159 and polypeptide SEQ ID NO: 160) can be used to manipulate the plant defense, wound, or insect response in order to generate pathogen resistant plants. In addition, the expression of the protein kinase represented by G2120 (polypeptide SEQ ID NO: 208) is increased more than 10-fold in response to infection of plants with the fungal pathogen *Erysiphe orontii*. Therefore, this protein kinase may also be used to manipulate the defense response of plants in order to generate pathogen resistance.

In another analysis, T2 progeny plants were tested for their ability to germinate in 80% Murashige and Skoog media plus vitamins (Sigma) at 32° C. under 24-hour light (120–130 µEin s$^{-2}$ m$^{-1}$) in a growth chamber. 32° C. is usually a restrictive germination temperature for plants. Plants containing the G682 (SEQ ID NO: 161) construct showed superior germination capacity than controls at 32° C. so G682 (SEQ ID NO: 161 and polypeptide SEQ ID NO: 162) can be used to confer heat tolerance to germinating seedlings.

T2 progeny plants were also examined for morphological alterations. Plants containing G682 (SEQ ID NO: 161) construct had reduced numbers of trichomes and plants containing the G732 (SEQ ID NO: 31) construct had highly reduced apical dominance, particularly in the inflorescence. Therefore, G682 (SEQ ID NO: 161 and polypeptide SEQ ID NO: 162) and G732 (SEQ ID NO: 31 and polypeptide SEQ ID NO: 32) can be used to alter plant growth and development.

EXAMPLE VII

Transformation of Cereal Plants with the Expression Vector

A cereal plant, such as corn, wheat, rice, sorghum or barley, can also be transformed with the plasmid vectors containing the sequence and constitutive or inducible promoters to modify a trait. In these cases, a cloning vector, pMEN020, is modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

Plasmids according to the present invention may be transformed into corn embryogenic cells derived from immature scutellar tissue by using microprojectile bombardment, with the A188XB73 genotype as the preferred genotype (Fromm et al., *Bio/Technology* 8: 833–839 (1990); Gordon-Kamm et al., *Plant Cell* 2: 603–618 (1990)). After microprojectile bombardment the tissues are selected on phosphinothricin to identify the transgenic embryogenic cells (Gordon-Kamm et al., *Plant Cell* 2: 603–618 (1990)). Transgenic plants are regenerated by standard corn regeneration techniques (Fromm, et al., *Bio/Technology* 8: 833–839 (1990); Gordon-Kamm et al., *Plant Cell* 2: 603–618 (1990)).

EXAMPLE VIII

Identification of Homologous Sequences

Homologs from the same plant, different plant species or other organisms were identified using database sequence search tools, such as the Basic Local Alignment Search Tool (BLAST) (Altschul et al. (1990) *J. Mol. Biol.* 215:403–410; and Altschul et al. (1997) *Nucl. Acid Res.* 25: 3389–3402). The tblastn or blastn sequence analysis programs were employed using the BLOSUM-62 scoring matrix (Henikoff, S. and Henikoff, J. G. (1992) *Proc. Natl. Acad. Sci. USA* 89: 10915–10919). The output of a BLAST report provides a score that takes into account the alignment of similar or identical residues and any gaps needed in order to align the sequences. The scoring matrix assigns a score for aligning any possible pair of sequences. The P values reflect how many times one expects to see a score occur by chance. Higher scores are preferred and a low threshold P value threshold is preferred. These are the sequence identity criteria. The tblastn sequence analysis program was used to query a polypeptide sequence against six-way translations of sequences in a nucleotide database. Hits with a P value less than −25, preferably less than −70, and more preferably less than −100, were identified as homologous sequences. The blastn sequence analysis program was used to query a nucleotide sequence against a nucleotide sequence database. In this case too, higher scores were preferred and a preferred threshold P value was less than −13, preferably less than −50, and more preferably less than −100.

Alternatively, a fragment of a sequence from Table 1 is $^{32}$P-radiolabeled by random priming (Sambrook et al., (1989) *Molecular Cloning. A Laboratory Manual,* $2^{nd}$ Ed., Cold Spring Harbor Laboratory Press, New York) and used to screen a plant genomic library. As an example, total plant DNA from *Arabidopsis thaliana, Nicotiana tabacum, Lycopersicon pimpinellifolium, Prunus avium, Prunus cerasus, Cucumis sativus,* or *Oryza sativa* are isolated according to Stockinger al (Stockinger, E. J., et al., (1996), *J. Heredity,* 87:214–218). Approximately 2 to 10 μg of each DNA sample are restriction digested, transferred to nylon membrane (Micron Separations, Westboro, Mass.) and hybridized. Hybridization conditions are: 42° C. in 50% formamide, 5×SSC, 20 mM phosphate buffer 1× Denhardt's, 10% dextran sulfate, and 100 μg/ml herring sperm DNA. Four low stringency washes at RT in 2×SSC, 0.05% sodium sarcosyl and 0.02% sodium pyrophosphate are performed prior to high stringency washes at 55° C. in 0.2×SSC, 0.05% sodium sarcosyl and 0.01% sodium pyrophosphate. High stringency washes are performed until no counts are detected in the washout according to Walling et al. (Walling, L. L., et al., (1988) Nucl. Acids Res. 16:10477–10492).

All references (publications and patents) are incorporated herein by reference in their entirety for all purposes.

Although the invention has been described with reference to the embodiments and examples above, it should be understood that various modifications can be made without departing from the spirit of the invention. Accordingly, the invention is limited only by the following claims.

SEQUENCE LISTING (218 sequences)

SEQ ID NO: 1 - DNA, 2361 bp, Arabidopsis thaliana
  CDS (144)..(2024): G274
aaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatctggtaccgtcgacccacgcgtccgaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 2 - protein, 627 aa, Arabidopsis thaliana
  G274
MTHNPTILRKTLPLYKEVHFIWRGHADKLTLADLVPSTHASEKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 3 - DNA, 2328 bp, Arabidopsis thaliana
  CDS (62)..(2107): G820
gggaaagaaagaaacttgactgctaattgctaaaggtaatgcttctgagaattggaagctaatgaagctcttcctcaatagcaatctgctcagaaactctattttcttcaagatctccgcctttgttttgatctccgttgcttgtttcttcctcggtaagcattggtctgaggatggcttccgccgtctcatcttcttctccgccgagccttcccgatctcccattgtcgcactctcacctgatttcggaaaaacctataacatctctggtttgatctatgagagtcacccgattttgcctccgtctttgtcaccaccgccgccgccagattctgttgagttgaaggtgtttggaatcgttaatgagaacggaacaatgtctgatgagtttcagattggtgattacgacgttgagtcggcggagacgttggggaatcagacggaattcgagagtagcgacgacgatgatattaaatccaccacagctagagttagtgtgaggaaatttgagatttgttcggagaatatgactgagtacattccttgtttggataatgtagaagccatcaaaaggcttaattcaacggcgcgtggtgagcgattcgaacggaattgtcctaacgatggaatgggattgaattgcaccgttccgattcctcaaggataccgtagtccgattccgtggccgagaagccgtgatgaggtgtggttcaacaatgttccacatactaaacttgttgaagacaaaggtggtcaaaattggatttataaagagaatgacaaatttaagtttcctggtggtggtactcagtttatacacggagctgatcagtacttggatcagatctctcagatgattcctgatattagctttggtaaccatacacgagttgttcttgacattggatgtggtgtggcaagttttggtgcctacttaatgtcacgaaatgtcttgactatgtctatagctccaaaagatgttcacgagaaccagatacagtttgctcttgagcgtggtgttcctgcaatggtggcagcattcacaacacggagattgttgtatccaagccaagcttttgatttggtacattgttcaagatgtagaatcaactggactcgtgatgatgggatcctgctccttgaagttaataggatgcttcgtgccggaggatattttgtttgggcagcacaacctgtatataagcatgaaaaggccttggaagaacagtgggaagagatgctaaacctgaccactaggctgtgctgggttcttgtaaagaaggaaggatatatagctatctggcagaagcctgtaaataacacttgttacctaagtcgtggtgctggagtcagtcctcctttgtgcaattctgaagatgacccagataatgtttggtacgtggatctgaaggcatgcatcactagaattgaagaaaatggatatggagcaaatcttgctccttggccagctcgtttactgaccccaccggataggctgcagacaatacaaattgattcatacatagcccgaaaagagctatttgtagccgaatcaaagtactggaaagaaataatatcaaactatgtaaatgccctacactggaagcagataggactcagaaatgtcttggacatgagagctggatttggcggatttgcagctgcattagctgagctaaaggttgactgctgggttcttaacgtcatcccagtgagtggtcccaacacattgcctgttatatatgaccgtggactgcttggagttatgcacgattggtgtgaaccttttgatacttacccaagaacctacgatttgctgcatgctgcgggtctgttttccattgaaagaaaaagatgcaacatgacaacaatgatgctagagatggaccggattttaagacctggaggacgtgtatacatacgggacacaatcaatgtaacgagtgagcttcaagagattggaaacgcaatgaggtggcacacgagcttacgtgaaactgctgaaggacctcactcaagttacagggttctcttatgtgagaagcggtttgaatcgtctgagaagcgtcgtaccaagaagaggaggaagactaaaggaaaaagagcttgacattttcatagaatacaagtgctgggctagaattttctggggatctttggatcaatggacaatggttagtttagttgggaggctttttggaattttagaaaaattagggacctgaaacagtgaaactgtttgtgaggttttggcgtttaaccctctttaaagttgattgaaaccggattaaactcacttaacccaaatataaaacttgtttattccat

SEQ ID NO: 4 - protein, 682 aa, Arabidopsis thaliana
  G820
MKLFLNSNLLRNSIFFKISAFVLISVACFFLGKHWSEDGFRRLIFFSAEPSRSPIVALSPDFGKTYNISGLIYESHPILPPSLSPPPPPDSVELKVFGIVNENGTMSDEFQIGDYDVESAETLGNQTEFESSDDDDIKSTTARVSVRKFEICSENMTEYIPCLDNVEAIKRLNSTARGERFERNCPNDGMGLNCTVPIPQGYRSPIPWPRSRDEVWFNNVPHTKLVEDKGGQNWIYKENDKFKFPGGGTQFIHGADQYLDQISQMIPDISFGNHTRVVLDIGCGVASFGAYLMSRNVLTMSIAPKDVHENQIQFALERGVPAMVAAFTTRRLLYPSQAFDLVHCSRCRINWTRDDGILLLEVNRMLRAGGYFVWAAQPVYKHEKALEEQWEEMLNLTTRLCWVLVKKEGYIAIWQKPVNNTCYLSRGAGVSPPLCNSEDDPDNVWYVDLKACITRIEENGYGANLAPWPARLLTPPDRLQTIQIDSYIARKELFVAESKYWKEIISNYVNALHWKQIGLRNVLDMRAGFGGFAAALAELKVDCWVLNVIPVSGPNTLPVIYDRGLLGVMHDWCEPFDTYPRTYDLLHAAGLFSIERKRCNMTTMMLEMDRILRPGGRVYIRDTINVTSELQEIGNAMRWHTSLRETAEGPHSSYRVLLCEKRFESSEKRRTKKRRKTKGKRA

SEQ ID NO: 5 - DNA, 2174 bp, Arabidopsis thaliana
  CDS (105)..(1940): G823
ggggatcggctgtagctctcacactatccactcttcatcggcagctagatttccgggtcctcagtatcgggtcagatctagatccggatccggagacgctgagaatgaaacacttcagaactgagcgagtccgtgcgactccgaagctcttcacctacgttctcgtcggtttcatcgctctactcggcttgacttgcctctactacggctcttcgttcgctcccggatccagaaagtccgatgagttcgatggatctaataaccgcgttcgcaccggaatcggatccttgaggaatcgagatattgtgcttgcagtgagccgtttcgaagttcctaaaagtgttccgatatgtgattcgagacactcggagttgataccgtgtttggatcggaaccttcattaccagttgaaattgaaactcaatttatcgttaatggagcactatgagcatcattgtcctccatcagaacggcgtttcaattgccttgttccgcctcctgttggttataagatcccgttaaggtggcctgtgagtagagacgaggtgtggaaggcgaatatcccgcacacacaccttgctcaagagaagtctgatcagaattggatggttgttaatggtgataagatcaattttcctggtggaggaacacatttccacaacggagctgacaaatacattgtttccctggctcagatgctgaaattccctggtgacaaactcaacaatgggggaagcattcggaatgttcttgacgttggttgtggggtagctagcttcggagcctatcttctttcacatgacatcatagccatgtctcttgcccctaatgatgtccaccagaaccagatccagtttgctctagaacgagggattccatcaacacttggtgttcttgggacaaagcggcttccatacccaagcagatcatttgaacttgctcactgctctagatgtcggatagattggcttcaaagagatgggatcttgttactggaacttgataggttgctcagacctggtggctactttgtatactcgtcgcctgaagcttatgcacacgacccagagaacagaaagattgggaatgcaatgcatgatctctttaagagaatgtgttggaaggtcgtggccaaacgagaccaatctgttatatggggaaaaccgatatccaacagctgttacttgaagagggatccgggtgtcctgcctccgctttgtccttctggagatgacccagatgcaacttggaatgtctcaatgaaggcttgcatatcaccttactcagtgaggatgcacaaagaaagatggagtggactcgttccctggccacggaggctgacagctcctccaccacgtcttgaagaaattggtgtcactcctgagcaattccgtgaagatacggaaacatggcggcttagagtgatagaatactggaaactgctgaaaccaatggtgcaaaagaactccataagaaacgtgatggacatgagctcaaaccttggcggtttcgcagctgctctaaacgataaagatgtatgggtaatgaatgtcatgcccgttcaatcctctccaagaatgaagatcatttacgaccgtggccttatcggagccactcatgattggtgtgaagcctttgacacatacccacgaacgtttgatcttatccacgcatggaacaccttcacagaaacccaagcacgtggatgcagctttgaagatctgcttatcgagatggatcggatactacgcccagaaggatttgtcataattcgtgacacaactgacaatattagctatatcaagaagtatctgacattattgaaatgggataaatggtccacagagacaactccaaaaggtgatcctctgtcgaccaaagacgagatagttttgatcgccagaaagaaactttggagcttgcccgccatttcagtgtcctgaaatctaacagtcaacaggcgaatgaatgagatttacagcatcagaggcgcgtagctgaggaaaatactcagcaatggagaagtgtaaattacacgacattcatacatagttgttaacttgttatgcatttgttgtaggaaactgcaaaatcttcttattttgcgattttcatgttcctctttataattaaaatctgcttttgtgagaaaaataaattgcttgattaatatg

SEQ ID NO: 6 - protein, 612 aa, Arabidopsis thaliana
  G823
MKHFRTERVRATPKLFTYVLVGFIALLGLTCLYYGSSFAPGSRKSDEFDGSNNRVRTGIGSLRNRDIVLAVSRFEVPKSVPICDSRHSELIPCLDRNLHYQLKLKLNLSLMEHYEHHCPPSERRFNCLVPPPVGYKIPLRWPVSRDEVWKANIPHTHLAQEKSDQNWMVVNGDKINFPGGGTHFHNGADKYIVSLAQMLKFPGDKLNNGGSIRNVLDVGCGVASFGAYLLSHDIIAMSLAPNDVHQNQIQFALERGIPSTLGVLGTKRLPYPSRSFELAHCSRCRIDWLQRDGILLLELDRLLRPGGYFVYSSPEAYAHDPENRKIGNAMHDLFKRMCWKVVAKRDQSVIWGKPISNSCYLKRDPGVLPPLCPSGDDPDATWNVSMKACISPYSVRMHKERWSGLVPWPRRLTAPPPRLEEIGVTPEQFREDTETWRLRVIEYWKLLKPMVQKNSIRNVMDMSSNLGGFAAALNDKDVWVMNVMPVQSSPRMKIIYDRGLIGATHDWCEAFDTYPRTFDLIHAWNTFTETQARGCSFEDLLIEMDRILRPEGFVIIRDTTDNISYIKKYLTLLKWDKWSTETTPKGDPLSTKDEIVLIARKKLWSLPAISVS

SEQ ID NO: 7 - DNA, 2137 bp, Arabidopsis thaliana
  CDS (106)..(2022): G1186
  "n" bases represent variable nucleotides
gatatttttttataaaatttccaccaccttacaaaagattttagctttttgtgttcctaattaaacccccaacaaaagttgcaagtctttcatctctatgcgccaatggcgaaagagaacagtagtcatagccttgcagaagcaaagagaaagagactcacttggattctttgtgtaagtggactttgcatattgtcttatgttcttggatcttggcaaaccaacactgtcccaacttcttcctctgaggcttactcaagaatgggatgtgatgaaacatcaacaaccactcgggctcagactactcagactcaaacaaatccttcttctgacgatacttcttcctctttgtcttcctcagaaccagttgagttagatttcgaaagccatcacaaactcgagctgaagattacgaatcaaaccgtaaagtactttgagccatgtgacatgtctttgagtgagtacactccatgtgaagatcgagagagaggaagaagatttgataggaacatgatgaagtacagagagagacattgtccttctaaagatgagcttctttattgtctgattcctcctccaccaaactacaagattccattcaagtggcctcaaagtagagattatgcttggtacgacaacattccacacaaggagcttagtattgagaaagctatccagaactggattcaagtagaaggggaaagattcaggttccctggtggtggcacaatgtttccacgtggagctgatgcttacattgatgatattgctagactcattcctcttactgatggagccattagaacagctattgatacaggatgtggtgtggcgagttttggtgcatacttgttgaagagggatattgtggctatgtcatttgctccaagggacactcatgaagctcaagttcaatttgcgttggaacgtggagttcctgcgattatcgggattatgggatcaagaaggcttccttatccagctagagcttttgatcttgctcactgttctcgttgtttgattccttggtttcaaaatgatggtttgtacttgaccgaagtggaccgggttttaagaccgggcggttattggatcctttcgggtccaccgatcaactggaagaaatactggaaaggctgggaaagatcacaagaggatttgaagcaagagcaagattctatagaagatgcagcaagaagtctttgttggaagaaagttacagaaaagggtgatttatcaatttggcaaaagcctatcaatcacgttgagtgtaacaaactcaaacgagttcacaaaactcctcctctatgcagtaaatcagatttacccgattttgcttggtacaaagatttggaatcttgtgtaacaccattaccagaagcaaacagttcagacgaattcgcaggcggtgcattggaggattggccaaaccgagcttttgcggtgccacctaggataatcgggggaaccattccggacattaatgctgagaaattcagagaagacaatgaagtgtggaaggagagaatatcatattacaaacagataatgccagagctttcaagaggaagatttaggaacataatggacatgaatgcatacttgggaggatttgctgcggcaatgatgaaatatccatcttgggttatgaatgtggttcctgtggatgctgagaagcaaacgttaggggttatctttgaacgaggatttatagggacttatcaagattggtgtgaaggattctctacgtatccgagaacttatgatttgattcatgctggtggattgttcagcatttatgagaacaggtgtgatgttacattaatactacttgagatggatagaattttgagaccagaaggaaccgtggtgtttagagacactgtggaaatgttgacgaagatacaaagcataaccaatggaatgaggtggaagagtcggattttggatcatgagagaggtccttttaatcctgagaagatccttctcgctgtaaaatcctattggaccggaccttcttcttagctagttctagctttcttggaactctctactctaatctttttcttatcttgtgtgtctcatctttgttttatttttaattgnttgntttaaaagatttctatgattatataag

SEQ ID NO: 8 - protein, 639 aa, Arabidopsis thaliana
  G1186
MAKENSSHSLAEAKRKRLTWILCVSGLCILSYVLGSWQTNTVPTSSSEAYSRMGCDETSTTTRAQTTQTQTNPSSDDTSSSLSSSEPVELDFESHHKLELKITNQTVKYFEPCDMSLSEYTPCEDRERGRRFDRNMMKYRERHCPSKDELLYCLIPPPPNYKIPFKWPQSRDYAWYDNIPHKELSIEKAIQNWIQVEGERFRFPGGGTMFPRGADAYIDDIARLIPLTDGAIRTAIDTGCGVASFGAYLLKRDIVAMSFAPRDTHEAQVQFALERGVPAIIGIMGSRRLPYPARAFDLAHCSRCLIPWFQNDGLYLTEVDRVLRPGGYWILSGPPINWKKYWKGWERSQEDLKQEQDSIEDAARSLCWKKVTEKGDLSIWQKPINHVECNKLKRVHKTPPLCSKSDLPDFAWYKDLESCVTPLPEANSSDEFAGGALEDWPNRAFAVPPRIIGGTIPDINAEKFREDNEVWKERISYYKQIMPELSRGRFRNIMDMNAYLGGFAAAMMKYPSWVMNVVPVDAEKQTLGVIFERGFIGTYQDWCEGFSTYPRTYDLIHAGGLFSIYENRCDVTLILLEMDRILRPEGTVVFRDTVEMLTKIQSITNGMRWKSRILDHERGPFNPEKILLAVKSYWTGPSS

SEQ ID NO: 9 - DNA, 2268 bp, Arabidopsis thaliana
  CDS (209)..(2017): G1190
tcctgtcccaaaaccaaaaggcttgagagtgtgtctttagagagagatcttctctcttttatcttacgactctcacttcttatctcaaatctacttcaactctatttccagtctccacattttcccacaaatttcaactcttgttctcttcatccaaagtaaaaaacaaatcgttgcaagtgaggtttggttttggtgttatagaattatgaagagcgggaagcaatcttcgcaacctgaaaagggtacttccaggatcttgtcactgactgtcctgtttatcgcattttgcggtttctccttctacctcggtggtatattttgctctgagagagacaagattgtagccaaggatgtcacaaggacgactacaaaggctgtagcttcccctaaagaacctacagctactcctattcaaatcaaatccgtttctttcccggagtgcgggtcagagttccaagattacaccccgtgcaccgatccaaagaggtggaagaagtatggtgtccatcgcttaagtttcttggagcgtcattgtcctccggtatatgaaaagaatgagtgtttgattccaccaccagacgggtataaaccgcctataagatggcccaagagccgagaacagtgttggtacaggaacgtgccttatgattggatcaataagcaaaagtctaaccagcattggcttaagaaagaaggagataagttccatttccctggtggtggtaccatgttccctcgtggagttagtcactatgttgatttgatgcaagatctgattcctgaaatgaaagacggaacagtcaggaccgccattgatactggctgtggggttgcgagctggggaggcgatcttttggaccgtgggatactatcactctctcttgctccaagagataaccatgaagctcaggttcaatttgctcttgaacgtggaattcctgcgattctcgggatcatctctacgcaacgtctcccttttccttcaaatgcatttgatatggctcattgttcaagatgtcttattccctggacagaatttggtggaatctatttacttgagattcaccgtatagttcgacctggaggtttttgggttctttctggtccacctgtgaactataatagacgatggcgtggatggaacacaaccatggaagatcagaaatctgactacaacaagcttcagtcacttctaacctccatgtgtttcaaaaagtacgctcaaaaagatgacatagccgtgtggcagaaactctcagacaaatcttgctatgacaaaatcgctaagaacatggaagcttaccctcccaaatgtgacgacagtatagaacctgattctgcttggtacactccactccgtccttgcgtggttgccccgacacctaaagtcaagaagtctggtctcggatcaatcccaaaatggcccgagaggttacatgtcgcgcccgagagaatcggtgatgttcacggagggagtgcgaacagtttgaaacacgatgatggtaaatggaagaacagagttaagcattacaagaaagttttaccagctcttgggacagacaagataagaaatgttatggatatgaacactgtttatggaggtttctctgcggccctcattgaggatcccatttgggtcatgaacgttgtatcatcgtacagcgcaaattcgcttcctgttgtctttgatcgcggtctcatcgggacttaccacgactggtgcgaagctttctcaacgtatccaagaacatatgatcttcttcacctcgacagtctttttaccttggagagtcacaggtgtgagatgaagtacattttgctagagatggacaggatcttgcggccgagtggatatgttataatccgagaatcgagttatttcatggacgcaatcacaacgttagcgaaagggataaggtggagttgccggagagaggagactgagtatgcagtcaaaagtgagaagattctggtttgccagaaaaagctatggttttcgtcaaaccaaacctcttgatgagaccacctgtatcatagtgtttatcatctcctgtgatgcacactacagagagaaggatctagtcctttgagtccaagatatagctctataaacaatctcctttttttgttctctttaatttcttgggtatttcacggtatagattgatattatatattttttaattatatttttaatatatagatatattagtatgtggtttaaacactattattatcaaggtcttaaagatttgctttgcaaga

SEQ ID NO: 10 - protein, 603 aa, Arabidopsis thaliana
  G1190
MKSGKQSSQPEKGTSRILSLTVLFIAFCGFSFYLGGIFCSERDKIVAKDVTRTTTKAVASPKEPTATPIQIKSVSFPECGSEFQDYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQKKLWFSSNQTS

SEQ ID NO: 11 - DNA, 838 bp, Arabidopsis thaliana
  CDS (83)..(634): G1090
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 12 - protein, 184 aa, Arabidopsis thaliana
  G1090
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 13 - DNA, 911 bp, Arabidopsis thaliana
  CDS (51)..(509): G1277
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 14 - protein, 153 aa, Arabidopsis thaliana
  G1277
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 15 - DNA, 1177 bp, Arabidopsis thaliana
  CDS (81)..(812): G1380
tttcttctcttcttcacacaaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgcacgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacgattaaaaagagagagagattgtgttaagatctgttactgtaagaaccagatctgggtttcatttttatctgtttcttcttataaaagatccaacaaccctttgttacatatatataacattctgaagctggtgatgatttctgaatgattcaaatccattatcttaaaaaaaaaaaa

SEQ ID NO: 16 - protein, 244 aa, Arabidopsis thaliana
  G1380
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 17 - DNA, 1473 bp, Arabidopsis thaliana
  CDS (436)..(1368): G1067
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 18 - protein, 311 aa, Arabidopsis thaliana
  G1067
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 19 - DNA, 2063 bp, Arabidopsis thaliana
  CDS (176)..(1909): G1216
ttttcatttttccgatcttggtaattgtcgtgttattcgccggaaaaagttaaagattcagatttaaagggtgggaattacattccccaaatttcgttgattggtgtgataataagccattgatcaacaatcttcttttgtggcaatcacataatcgtgttatgcattctgagaaatggtgtcgcataagtgtgtagaagaatttggatacgcaagctacctggtaccttccaatgcaagagcacccagatccgcccggaagaggcgcagtatcgagaagaggataagtaaagaagatgataatatgtgtgcaattgatctattggccaccgtagctggacacttgtcatttgagagtgggagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcagatacgaaaccgtggagaaattattacttgcaccagcagaggagctatcctatcaagaaaaggaaaaactttgaccacatatctgattccgttactgatgattaccgtatgcgtactaagatgcatagaggtagtagaaaaggtcaaggggcatcctttgtggcaagcgactcccatgtgaaactacggatcaagtcgttcagggtgcctgagcttttcatagagattccagaaactgctactgttggctcattgaagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtggagagatgttaagctttgtgctttcgaggatgctgaccaccgcacttacgtagatctcaaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaaatgaatctgctgcagccttggaggtcgtctctcctttgtgtattactactactattgatgattatgtaagattctgacatagatgcaaagatttggtcttttactttggtttgatttttttaacttttctcaatgtaaagtttttaactgg

SEQ ID NO: 20 - protein, 578 aa, Arabidopsis thaliana
  G1216
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 21 - DNA, 1333 bp, Arabidopsis thaliana
  CDS (45)..(1154): G295
ctgttttctaaggccactaatcactcggatttgtgtcaggtgaaatggatagttactggagacttaaaaacttggtgaatgatttgccagttagtacttctttaagccgacaaggatcaatatactcatggacagtagatcagtttcagaccagcttagggttagattgtggatcaatgaacatggatgagttggttaagcatatatcaagtgctgaagaaacacaagaggggtcgcagaggcaaggctcaactactctgcctccaacacttagcaaacaaaatgttggtgaagtttggaaatctatcacagaggaaaaacacaccaataacaatggaggagtaacaaacattactcatcttcagggacaacaaaccttaggggaaatcactcttgaagagtttttcatccgtgctggagcaagaggaggtaataccaatggtggctccattcatgactcatcgtcatcgatttccggtaatccacacactagtttgggtgttcagattcagccaaaagccatggtttctgattttatgaacaatatggttccaaggagtcatgattcttatttgcatcaaaatgtgaatggatctatgtcaacatatcaaccacaacaatctatcatgtctatgccaaatggttattcttatggaaaacaaatccgattctcaaatggttccttgggatctggtaaccaaagtctccaagatacgaagagaagcttggtcccaagtgttgcgacaattccaagtgaagccataacatgttcaccggttaccccatttccaacattaaatgggaaacaaaagattaacggtgagtcttcattactctcaccatctccatacattagtaatggtagtactagtacaagaggtgggaagattaatagtgaaattaccgcggaaaaacaattcgttgacaaaaagcttaggagaaagattaagaaccgagaatccgcagcgagatcacgggctcgaaagcaagctcaaactatggaggttgaagttgaacttgaaaacttaaagaaagattatgaagagctactaaaacaacatgtagagttgcggaaaagacaaatggaaccaggaatgattagccttcatgaacgaccggagagaaagctgaggagaacgaaatcggacatcaagtgaatcaatgaaacccgagttggaggatgatgatgagtttattttgttcatcatgttttgttttcgtatatttttgaccaaataagctatttattagacatcttattcttaaacccatttgataatgtcctaaagatcgaattctcatggtctaggggaaaatccaaaacttattttta

SEQ ID NO: 22 - protein, 370 aa, Arabidopsis thaliana
  G295
MDSYWRLKNLVNDLPVSTSLSRQGSIYSWTVDQFQTSLGLDCGSMNMDELVKHISSAEETQEGSQRQGSTTLPPTLSKQNVGEVWKSITEEKHTNNNGGVTNITHLQGQQTLGEITLEEFFIRAGARGGNTNGGSIHDSSSSISGNPHTSLGVQIQPKAMVSDFMNNMVPRSHDSYLHQNVNGSMSTYQPQQSIMSMPNGYSYGKQIRFSNGSLGSGNQSLQDTKRSLVPSVATIPSEAITCSPVTPFPTLNGKQKINGESSLLSPSPYISNGSTSTRGGKINSEITAEKQFVDKKLRRKIKNRESAARSRARKQAQTMEVEVELENLKKDYEELLKQHVELRKRQMEPGMISLHERPERKLRRTKSDIK

SEQ ID NO: 23 - DNA, 1360 bp, Arabidopsis thaliana
  CDS (250)..(1239): G555
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 24 - protein, 330 aa, Arabidopsis thaliana
  G555
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 25 - DNA, 1888 bp, Arabidopsis thaliana
  CDS (326)..(1705): G571
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 26 - protein, 460 aa, Arabidopsis thaliana
  G571
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 27 - DNA, 1054 bp, Arabidopsis thaliana
  CDS (43)..(744): G580
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 28 - protein, 234 aa, Arabidopsis thaliana
  G580
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 29 - DNA, 1661 bp, Arabidopsis thaliana
  CDS (190)..(1458): G631
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 30 - protein, 423 aa, Arabidopsis thaliana
  G631
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 31 - DNA, 834 bp, Arabidopsis thaliana
  CDS (73)..(585): G732
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 32 - protein, 171 aa, Arabidopsis thaliana
  G732
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 33 - DNA, 2946 bp, Arabidopsis thaliana
  CDS (129)..(2765): G886
gaaaaagctaaactttgctctgttttttcaacaaaaaaagtgaactttgctctgttccgtccatgtccgatgatgatcggagtggaagcagaatgagatttgaagcaaacgtctagagttccgacgttatgggttgcggaggatcaaaagtagataatcaaccaatagtgattctctgtagagaacgaaaggagctgcttaaagcggcgtcgtatcatcgttctgctctcgctgtcgctcacctaacttacttccagtctctctccgacgtcggtgaagctattcaacgtttcgttgacgacgaagtcgtagctggtttttcttcttcttcttcgccggattctccagttcttacacttccgtccgacgaagggaaaccgacgaaacacaagaggatttctccttcttcaaccacctcaatttctcattccgtcatcgaagaagaagacactgatgatgattcgcatttgcatctaagctccggatccgaatccgaatcagaagttggatctaaggatcatatccaaattactagcactccagaacaagagcggtcaacggaatcatttccttccggttatcatccaacaaactatgctccaccggtttacccacctggttatccacccggttacccattcagttacccgaccggttattcatcgggtaattatcaaccgggttacccgaattacacaggtgagaatccatacggaaatcgaggaatgtattacatgaagaaatctgcgccacaatcacgaccgttcattttccaaccggagaatcatcgagtggaggagaacgcgcaatggccgtcggattctggatttagaaacacaggagtgcaacggagatcgccgtctccgttacctcctccgtcaccacctacggtttcaacttgggattttttgaatgtgtttgatacttatgattacagcaacgcccgttctcgtgcttcgggatattatccgatgggaatggcgtcaatctcaagcagtcctgattcgaaggaagttagagaaagagaagggattcctgagctagaagaagtaacagagcaagaagttatcaagcaagtgtatagacgtcccaagagaccaggattggagaaggttaaagaacacagagacgagcacaagcacaacgtttttcctgagaggaacattaacaaaagggaagttccaatgccagaacaagtcactgagagctcattggattcagagacaatttcgtctttttcaggaagtgatgtagaatcggagtttcactatgttaatggtggtgaaggaaagagtagcagcatcagttcaatcagtcatggggctgggacaaagagctcgagagaagtagaagaacagtatgggaggaaaaaaggagtgagctttgagttggaggaaacaacgagcacttcgtcttttgatgttgaatcttccaagataagtagcttatccagtttgtcgattcatgccactagggatctcagagaagttgttaaggagatcaagagtgagttcgagattgcttcttcttgtgggaaggaggttgctttgttacttgaagtcggcaagttgccttatcagcataaaaacaatggcgttaaagttatcttatccaggatcatgtatctggtagcaccatccacacggtcatcgcactctcagcccagactatcaatacgtttaacatctagaactcgaaaaatggcgaaatcatacaatggacaagatgttaatggaggcttcaatggaaacctctcatcaaccttagagaaactgtatgcgtgggaaaagaaactgtacaaggaagtcaaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttcatattcaattattggttggttagtttcccttgtaaaccgtttttaaatggtgaagaagaagatatctaaaaaaa

SEQ ID NO: 34 - protein, 879 aa, Arabidopsis thaliana
  G886
MGCGGSKVDNQPIVILCRERKELLKAASYHRSALAVAHLTYFQSLSDVGEAIQRFVDDEVVAGFSSSSSPDSPVLTLPSDEGKPTKHKRISPSSTTSISHSVIEEEDTDDDSHLHLSSGSESESEVGSKDHIQITSTPEQERSTESFPSGYHPTNYAPPVYPPGYPPGYPFSYPTGYSSGNYQPGYPNYTGENPYGNRGMYYMKKSAPQSRPFIFQPENHRVEENAQWPSDSGFRNTGVQRRSPSPLPPPSPPTVSTWDFLNVFDTYDYSNARSRASGYYPMGMASISSSPDSKEVREREGIPELEEVTEQEVIKQVYRRPKRPGLEKVKEHRDEHKHNVFPERNINKREVPMPEQVTESSLDSETISSFSGSDVESEFHYVNGGEGKSSSISSISHGAGTKSSREVEEQYGRKKGVSFELEETTSTSSFDVESSKISSLSSLSIHATRDLREVVKEIKSEFEIASSCGKEVALLLEVGKLPYQHKNNGVKVILSRIMYLVAPSTRSSHSQPRLSIRLTSRTRKMAKSYNGQDVNGGFNGNLSSTLEKLYAWEKKLYKEVKDEEKLRAIYEEKCRRLKKMDSHGAESIKIDATRAAIRKLLTKIDVCIRSVDSISSRIHKLRDEELQPQLIQLIHGLIRMWRSMLRCHQKQFQAIRESKVRSLKANTTLQNDSGSTAILDLEIELREWCISFNNWVNTQKSYVQFLSGWLTKCLHYEPEATDDGIAPFSPSQIGAPPIFIICKDWQEAMCRISGENVTNAMQGFASSLHELWEKQEEEQRVKAQSEQRDAESERSVVSKGRSESGISALDDLKVDLDSMRKRLVEERGKGKETIKLVNNASSSSLKAGLVPIFGALRKFTSEVVKAHEIVRLQHPQTSS

SEQ ID NO: 35 - DNA, 1766 bp, Arabidopsis thaliana
  CDS (23)..(1579): G1050
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 36 - protein, 519 aa, Arabidopsis thaliana
  G1050
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 37 - DNA, 1304 bp, Arabidopsis thaliana
  CDS (138)..(1124): G1052
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 38 - protein, 329 aa, Arabidopsis thaliana
  G1052
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 39 - DNA, 549 bp, Arabidopsis thaliana
  CDS (38)..(535): G1053
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 40 - protein, 166 aa, Arabidopsis thaliana
  G1053
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 41 - DNA, 2221 bp, Arabidopsis thaliana
  CDS (1)..(2025): G1055
atgacggaatcaacatccgtggttgctcctccgccggagatacctaatctgaaccctagcatgttttctgagtccgatttgttttctattccgccgctagatcctcttttcctatctgattctgatccgatttcaatggatgcgccaatctccgatctcgacttcttactcgacgatgagaacggagatttcgctgattttgatttctcgtttgataattctgatgatttcttcgatttcgatttatcggagcccgcggtggtgatccctgaggagatcggtaacaatcgttcgaatttggactcatcggaaaacagaagcggcgatggaggtttagaaggaagatctgagtctgttcattcacaggtttcatctcaaggctccaagacttttgtgtccgacaccgttgacgcatcatcctcccctgaatcaagcaatcaccagaaatcttctgttagcaagaggaagaaggaaaatggagactccagtggcgaattaaggagctgcaagtaccaaaagtccgatgataaatcagtcgctacgaacaacgaaggtgatgatgacgacgacaagaggaagttgataaggcagattaggaaccgtgaaagtgctcagctttcgaggttgaggaagaagcaacaaactgaggagcttgaaagaaaagtgaagagtatgaatgctaccattgctgaattgaatggtaagattgcttatgttatggctgagaatgtcgctttaaggcaacaaatggctgttgcttctggtgctcctcctatgaatccttatatggctgccccgcctttaccgtatcaatggatgccgtatccgccgtatcctgttaggggatatggatcacagacacctttggttcccattcctaagttaaatcctaagcctgtctcgagttgtagaccgaagaaggcagagagtaagaagaatgagggtaaaagtaagctcaagaaggttgctagtattagttttattggaattctcttctttgtcttcttgtttggtacattggttccttttatgaatgtaaattttggaggagaacgtggaagctttggcggtttgtctaaatatgatggccaccggtattacgatgaacataaggggagggttttaatggtcggcgatggttctgatgttagaagaaatagtggaatttctgaaggaaatatccattctagtaggattagtcatggtgagagagatagttgtggaggagtagattataatgctcatccgaaagtagaaggacgaccaagttcgttgagcaatgccagtgatcctctctttgcttctctctatgtcccaagaaacgatgggcttgtgaagatcgatgggaacttgataattcactctgttttggcgagcgagaaagcaaggggtttaggaaagaagaatatcactgaaacagtaaaaactaaagaaccggatttgaccattcctggtgcactgtcttctgcattagctgttccgggggtaagaggaaatgcagcaatgcttccgcattcaacagctctctcttctgaagggaaaagacttcaccaatggtttcatgaaggtggctcagggccactaatggattacagcatgtgcaccgaggttttccagtttgatattgctcctggtgctatagtcccgtcatcagtctccagcatttctgcggagcatctccaaaatgtcactacccacggcaagagaatgaagaacaggagaatccttgagggacttcctgtttcacttgtggcgtcagagctcaatatcaccggaacccagccaaacaaagacgctcaaaataagacctttaatggaaacactaacaaacccacatcatcatcctccatggttgtctcagtgttacttgatccaagagaggtcgttgactctgaaaccgacagagtggttcccccaaacccaaaatcactttcccggatctttgtggtggtgcttcttgacagtgtcaagtacgttacctactcatgcgttcttcctcgatcgggtctccatctcgtagccacctgatttgagctactcagatcttgaccttaagtaggcgaacattgacttgtttatacatacagaccttgttgactttttttccctgtgttgtataactcttatgttctaaggttttggattttaattttgagataagcataaagtggaatccttgttttaaaggcatttccaatagctttaggctgataatacatcc

SEQ ID NO: 42 - protein, 675 aa, Arabidopsis thaliana
  G1055
MTESTSVVAPPPEIPNLNPSMFSESDLFSIPPLDPLFLSDSDPISMDAPISDLDFLLDDENGDFADFDFSFDNSDDFFDFDLSEPAVVIPEEIGNNRSNLDSSENRSGDGGLEGRSESVHSQVSSQGSKTFVSDTVDASSSPESSNHQKSSVSKRKKENGDSSGELRSCKYQKSDDKSVATNNEGDDDDDKRKLIRQIRNRESAQLSRLRKKQQTEELERKVKSMNATIAELNGKIAYVMAENVALRQQMAVASGAPPMNPYMAAPPLPYQWMPYPPYPVRGYGSQTPLVPIPKLNPKPVSSCRPKKAESKKNEGKSKLKKVASISFIGILFFVFLFGTLVPFMNVNFGGERGSFGGLSKYDGHRYYDEHKGRVLMVGDGSDVRRNSGISEGNIHSSRISHGERDSCGGVDYNAHPKVEGRPSSLSNASDPLFASLYVPRNDGLVKIDGNLIIHSVLASEKARGLGKKNITETVKTKEPDLTIPGALSSALAVPGVRGNAAMLPHSTALSSEGKRLHQWFHEGGSGPLMDYSMCTEVFQFDIAPGAIVPSSVSSISAEHLQNVTTHGKRMKNRRILEGLPVSLVASELNITGTQPNKDAQNKTFNGNTNKPTSSSSMVVSVLLDPREVVDSETDRVVPPNPKSLSRIFVVVLLDSVKYVTYSCVLPRSGLHLVAT

SEQ ID NO: 43 - DNA, 1663 bp, Arabidopsis thaliana
  CDS (118)..(1344): G1057
tgcaaaattaagctcagagattcacaccgcatctgaaattgtgctcagaggggttccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtgagaagacatagagcaaaaccaattcctaacacaggtataaaaaagtagcagcagcagcaacaacaacactcggcggttctttgctaacagatggtttgtaggattttaggcatcagagatcgattggttccgaatagtttattgagggttgttggtccagtgtatgtgtgtgtaagttacgaaattagatattgggagaaaaaattccctcgtttaatgttttactttgcctttgctctacttgcagaagcgaatctgaggcaatgtgcttatctgtatcaaaattgttaccctttttattagcttttcctatttat

SEQ ID NO: 44 - protein, 409 aa, Arabidopsis thaliana
  G1057
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 45 - DNA, 2663 bp, Arabidopsis thaliana
  CDS (31)..(2424): G1089
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 46 - protein, 798 aa, Arabidopsis thaliana
  G1089
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 47 - DNA, 1357 bp, Arabidopsis thaliana
  CDS (243)..(1139): G1145
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 48 - protein, 299 aa, Arabidopsis thaliana
  G1145
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 49 - DNA, 1780 bp, Arabidopsis thaliana
  CDS (230)..(1672): G1198
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggccttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagcagcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 50 - protein, 481 aa, Arabidopsis thaliana
  G1198
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 51 - DNA, 1334 bp, Arabidopsis thaliana
  CDS (17)..(1225): G1278
ggcgattgggtaagcgatgcacatcgtcttctctgtcgatgatttgaccgaatccttctggcctgttcccgctccggcgccgtcgccgggatcgtcatcgactccgtcaccgacgcagaacgtggcggatgggatgactcgaagtcaatcggagtgggcgttccacaggcttatcaatgagttgtctggttccgattcgagccctacgactaacacaatcgagagatcacctccaccggttcagtctctttcgagattagaagaaaccgttgacgaaaccgaagatgttgttgagattcagaaaccgcagaatcatcgacggctccctgttgatgatcaagggaagaatcggaatcgtgctccgtcgtctgatccggttgattcttcagctcctgttgttgttgatcctaatcagtatcatgcgattcttaagagcaagctcgagcttgcttgcgctgctgttgctcgtcgtgtgggaactgtgaaaccggaagattcgagtgcttcagctagcaatcaaaaacaagctcaaggctccattgtggcacaaacctcacctggtgcttcatctgttagattttctcccacaacaagcacgcaaaagaaacctgatgttccagccagacaaactagtatttcatcacgagatgattctgatgacgatgatcttgatggagacgcagataatggagatcctactgatgtgaagcgtgctaggaggatgctctcaaaccgagaatccgctaggcgctctaggagaagaaagcaagaacaaatgaatgaatttgatacacaggtaggccaattaagagccgagcattcaactttaattaatcgtcttagtgacatgaatcataagtatgatgcagctgctgttgacaacagaattctaagagctgatatcgaaactttgagaacaaaggttaagatggcagaggaaactgtgaaaagagtgacaggagtgaaccctttgcattggtcaagaccaaacatgggcataccattcagcaacacaccgagtgcttcctctagtattccgccaaactctaaccacattttgaaaccagcaaattcaagtaccaacaccagtgctggtttagcacaaaatcagagagtggagacggcaaattttttgccggaacaggtgaaccgtgaaggcatgcagaatccatttgctcctgattttaatctgtatgaaaccctaccccattggaatcccaagcattaaccagaaaaagagtcattggttttgtgattttgattgaggtaactattgtctgtatttttatttactgtatgactcagcgacggtaaactcttaatattatatatat

SEQ ID NO: 52 - protein, 403 aa, Arabidopsis thaliana
  G1278
MHIVFSVDDLTESFWPVPAPAPSPGSSSTPSPTQNVADGMTRSQSEWAFHRLINELSGSDSSPTTNTIERSPPPVQSLSRLEETVDETEDVVEIQKPQNHRRLPVDDQGKNRNRAPSSDPVDSSAPVVVDPNQYHAILKSKLELACAAVARRVGTVKPEDSSASASNQKQAQGSIVAQTSPGASSVRFSPTTSTQKKPDVPARQTSISSRDDSDDDDLDGDADNGDPTDVKRARRMLSNRESARRSRRRKQEQMNEFDTQVGQLRAEHSTLINRLSDMNHKYDAAAVDNRILRADIETLRTKVKMAEETVKRVTGVNPLHWSRPNMGIPFSNTPSASSSIPPNSNHILKPANSSTNTSAGLAQNQRVETANFLPEQVNREGMQNPFAPDFNLYETLPHWNPKH

SEQ ID NO: 53 - DNA, 757 bp, Arabidopsis thaliana
  CDS (253)..(687): G1366
ctaatctcttctcttctcttaaaatcaaacgtaatcataaataaagatcttcttgtttaatttctcttgatcctcgcaaaatcacagattcttgaaattcttttttcttgtcttgaaattcttgagttcttgagttatgaaaagacaatggacagagttatgaaatgataaatctcaaccaattccttgtttatcattctatatcagttgtgattcttcattggttttacgttatctcttgaacaaaaaaacatggcaaacgcagagaagacaagttcaggttccgacatagatgagaagaaaagaaaacgcaagttatcaaaccgcgaatctgcaaggaggtcgcgtttgaagaaacagaagttaatggaagacacgattcatgagatctccagtcttgaacgacgaatcaaagagaacagtgagagatgtcgagctgtaaaacagaggcttgactcggtcgaaacggagaacgcgggtcttagatcggagaagatttggctctcgagttacgttagcgatttagagaatatgattgctacgacgagtttaacgctgacgcagagtggtggtggcgattgtgtcgacgatcagaacgcaaacgcgggaatagcggttggagattgtagacgtacaccgtggaaattgagttgtggttctctacaaccaatggcgtcctttaagacatgagatttgtgtattagtgtgtgttttactttggtcattttatagtttttgtaatctttttatatcgaat

SEQ ID NO: 54 - protein, 145 aa, Arabidopsis thaliana
  G1366
MANAEKTSSGSDIDEKKRKRKLSNRESARRSRLKKQKLMEDTIHEISSLERRIKENSERCRAVKQRLDSVETENAGLRSEKIWLSSYVSDLENMIATTSLTLTQSGGGDCVDDQNANAGIAVGDCRRTPWKLSCGSLQPMASFKT

SEQ ID NO: 55 - DNA, 953 bp, Arabidopsis thaliana
  CDS (123)..(716): G929
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagtaaaaaaaaa

SEQ ID NO: 56 - protein, 198 aa, Arabidopsis thaliana
  G929
MTSSVHELSDNNESHAKKERPDSQTRPQVPSGRSSESIDTNSVYSEPMAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 57 - DNA, 1180 bp, Arabidopsis thaliana
  CDS (85)..(1068): G931
ggaggttctttgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagctagttcttatttcacacgctttgtccagatatc

SEQ ID NO: 58 - protein, 328 aa, Arabidopsis thaliana
  G931
MDKKVSFTSSVAHSTPPYLSTSISWGLPTKSNGVTESLSLKVVDARPERLINTKNISFQDQDSSSTLSSAQSSNDVTSSGDDNPSRQISFLAHSDVCKGFEETQRKRFAIKSGSSTAGIADIHSSPSKANFSFHYADPHFGGLMPAAYLPQATIWNPQMTRVPLPFDLIENEPVFVNAKQFHAIMRRRQQRAKLEAQNKLIKARKPYLHESRHVHALKRPRGSGGRFLNTKKLQESTDPKQDMPIQQQHATGNMSRFVLYQLQNSNDCDCSTTSRSDITSASDSVNLFGHSEFLISDCPSQTNPTMYVHGQSNDMHGGRNTHHFSVHI

SEQ ID NO: 59 - DNA, 1410 bp, Arabidopsis thaliana
  CDS (84)..(1361): G795
cgaaaaaataaaagaggaatcaattttttcatatatagccaaagtcacatagtgattcttctccaatcaaatctctatcaacaatgacaagcttgcacaaaaccctcttcacacaaaatcccactactttagatcaactcatgatgtgccacacgggaagagacaattcatggaaaaaactagaaaacatagacgaagaaggtccatcgacggtggcacgtgaagtgaggacggcgttaccaccggagacgccaacggagatgatggagttcttggggagatcatggagcatttccgccgtcgaactcacgagagcttttttcaacaattccactgccgacactaactcttttcttctatctactatcgttaacaccaacaaagaagacagagaagatgaagaagattctacttccatggcttcttctcgtgaccttctgctgccacatgtgggaaataagaccagccctccaataactccaagaaccggtagagaaatgaagcatttgtacaagagcatgataagaggaagaacaatgggaagaagattaaaggatcagaaggagaagaagaaacaagagaccagaactcgcaacgctgagattcacgccgcggtctctgtcgcaggagtagctgcagttgttgccgcaaccgcagcatctaacgctattgcggccgcagaagatgcggttgaatcaacaaccgttgcagctgcaatggcatctgcagctgctctcatcgcttcacattgcatcgagatagcgggagagattggggcgggttataaccagattgccacggctgttagctccgcgaccaatgctaggactaacggagacattatggctttaacggcaagtgctgcaacagcgttgcgaggagctgcgattctaaggtcacgaatggaaaggaacaacgagaacaaagcaatgctatatgcaacaaaggagcacgtcgtagaaatggaagagagaaatgtatttggagcgatgactttcgtctctagaggagaagagcttctcaaacgcacccgcaaaggggatcttcattggaagcaagtatcttttaacatcaattccaattggcaagtggttcttaaaatgaagagcaaacatgtgggtggaactttcacgaagacgaagaaatgcgttgtcaatggagtgtgccgagatatacccgaatgggcacatagaggacgagcagataaaatggtagagcgaagagcctactttggggtgaaaacagtggaaagggtgattgaattcgaatgtggaaacaaaagagagaagcaaatgtggatagaggggattcaacagttgcttaactcactcgaaatcggttctagtgttcaatggaaacattagagttaggatcaaattaaaacactatttcacatttgaacatcatgta

SEQ ID NO: 60 - protein, 426 aa, Arabidopsis thaliana
  G795
MTSLHKTLFTQNPTTLDQLMMCHTGRDNSWKKLENIDEEGPSTVAREVRTALPPETPTEMMEFLGRSWSISAVELTRAFFNNSTADTNSFLLSTIVNTNKEDREDEEDSTSMASSRDLLLPHVGNKTSPPITPRTGREMKHLYKSMIRGRTMGRRLKDQKEKKKQETRTRNAEIHAAVSVAGVAAVVAATAASNAIAAAEDAVESTTVAAAMASAAALIASHCIEIAGEIGAGYNQIATAVSSATNARTNGDIMALTASAATALRGAAILRSRMERNNENKAMLYATKEHVVEMEERNVFGAMTFVSRGEELLKRTRKGDLHWKQVSFNINSNWQVVLKMKSKHVGGTFTKTKKCVVNGVCRDIPEWAHRGRADKMVERRAYFGVKTVERVIEFECGNKREKQMWIEGIQQLLNSLEIGSSVQWKH

SEQ ID NO: 61 - DNA, 1231 bp, Arabidopsis thaliana
  CDS (107)..(1081): G805
tatagagagaggaaaaaactatggctcacataaagatctaacagagacagtagtatagtcccacttcccccccaccaaagcttcgatcatcatcatcatcatcatcatggatccggatccggatcataaccatcgacccaacttccctctccagcttcttgattcttctacctcctcctcttccacttccttagccatcatctctactacttccgaacctaactccgaacctaagaagcctcctcctaaacgaacctctactaaagaccgacacaccaaagtcgaaggccgaggccgtcggatccgtatgcctgccatgtgtgctgcacgtgtctttcagctcacacgtgagcttggtcacaaatccgacggtgaaactattgagtggctactccaacaagcagaaccagcggttatagccgctacagggactggaaccattccggctaacttcacttctttaaacatctcacttcgtagctcaagatcttctctctctgctgctcatcttcgtacaactcctagtagctattactttcattcaccacatcagtccatgactcatcatcttcaacatcagcatcaggttcgtcccaagaacgagtcacattcttcgtcttcttcttcttcacagcttttagatcacaaccaaatgggtaactatctagtacaatcaactgctggatctttacctacgagtcagagtcctgcaacggcaccgttttggagtagtggtgacaacacacagaatctttgggcttttaatattaatcctcatcattccggtgttgtcgccggagatgtttacaaccccaacagtggtggtagtggcggcggtagtggagttcatttgatgaattttgcagctcctattgctttgttttctggacagcctttggcttctggttatggaggaggaggaggtggcggtggagaacatagccattatggagttttagcggcgttgaatgctgcttaccgaccggtggcggagacggggaaccataacaacaaccagcaaaaccgtgacggagatcatcatcacaaccatcaagaagatggaagcaccagtcatcattcctaggcaaacatacacaaacaaatatattctgtgagatttatttttctttttttgtcctttcgtttgtttgtttgttcttaacaagcgtgttttttttgcattgcttctttttcatatatttttatttatttctaaattctaataaaaaaa

SEQ ID NO: 62 - protein, 325 aa, Arabidopsis thaliana
  G805
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGGGGGGGGEHSHYGVLAALNAAYRPVAETGNHNNNQQNRDGDHHHNHQEDGSTSHHS

SEQ ID NO: 63 - DNA, 1011 bp, Arabidopsis thaliana
  CDS (84)..(770): G1398
ggtcattgaatcattgatcgtgcatcaaagatactacaaaaagaagaaaatcaaatatataaagaaagaaggcgagtcattttatgacaacgagaaacagaacatcactaccaaacatctccagctcagtttcttcaaataaaaacattgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtatttgatgtaatgacgttctttagtttgcttaatgtgggtttaatatggcaacatagaaagttataaggtcaacatcttatattgattgggctgcgtttgttaatttgatttgtatttgtacatcttttcattgaaaggctttctcttagctttatgaattggtaagtacaataatacatatttgttctttaaaaaaaa

SEQ ID NO: 64 - protein, 229 aa, Arabidopsis thaliana
  G1398
MTTRNRTSLPNISSSVSSNKNIVVPNIMAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEQLEKKKAEYVEQMKNKIAQIHKEAEEKRAMIEAKRGEEILKAEELAAKYRATGTAPKKLFGCM

SEQ ID NO: 65 - DNA, 1384 bp, Arabidopsis thaliana
  CDS (45)..(1202): G723
atttttcaaaaaacctttagaattttcatttttttacgattccgatgttaactgtttctccggctccagtactcatcggaaacaactcaaaggatacttacatggcggcagatttcgcagattttacgacggaagacttgccggactttacgacggtcggggatttttccgatgatcttcttgatggaatcgattactacgacgatcttttcattggtttcgatggagacgatgttttgccggatttggagatagattcggagattcttggggaatattccggtagcggaagagatgaggaacaagaaatggagggtaacacttcgacggcatcggagacatcggagagagacgttggtgtgtgtaagcaagagggtggtggtggtggtgacggtggttttagggacaaaacggtgcgtcgaggcaaacgtaaagggaagaaaagtaaagattgtttatccgatgagaacgatattaagaaaaaacctaaggtggattggacgccggagttacaccggaaatttgtacaagcggtggagcaattaggggtagacaaggcggtgccgtctcgaatcttggaaattatgaacgttaaatctctcactcgtcacaacgttgctagccatcttcagaaatataggtcacatcggaaacatctactagcgcgtgaagcagaagctgccagctggaatctccggagacatgccacggtggcagtgcccggagtaggaggaggagggaagaagccgtggacagctcctgccttaggctatcctccacacgtggcaccaatgcatcatggtcacttcaggcctttgcacgtatggggtcatcctacgtggccaaaacacaagcctaatactccggcgtctgctcatcggacgtatccaatgccggccattgcggcggctccggcatcttggccaggtcatccaccgtactggcatcagcaaccactctatccacagggatatggtatggcatcatcgaatcattcaagcatcggtgttcccacaagacaattaggacccactaatcctcccatcgacattcatccctcgaatgagagcatagatgcagctattggggacgttatatcaaagccgtggctgccgcttcctttgggactgaaaccgccgtcggttgacggtgttatgacggagttacaacgtcaaggagtttctaatgttcctcctcttccttgagaaagatctccaaaatttgtcgaaatctcaaacttttaacttcatttttttggtatcttctatgtatttttgcaagggaaagacgataaatccttgttgcttgatcatatgtatttctctatatgagtgcatgtatcgaagttaagcaactttaatatatcgttataatcttcgataaa

SEQ ID NO: 66 - protein, 386 aa, Arabidopsis thaliana
  G723
MLTVSPAPVLIGNNSKDTYMAADFADFTTEDLPDFTTVGDFSDDLLDGIDYYDDLFIGFDGDDVLPDLEIDSEILGEYSGSGRDEEQEMEGNTSTASETSERDVGVCKQEGGGGGDGGFRDKTVRRGKRKGKKSKDCLSDENDIKKKPKVDWTPELHRKFVQAVEQLGVDKAVPSRILEIMNVKSLTRHNVASHLQKYRSHRKHLLAREAEAASWNLRRHATVAVPGVGGGGKKPWTAPALGYPPHVAPMHHGHFRPLHVWGHPTWPKHKPNTPASAHRTYPMPAIAAAPASWPGHPPYWHQQPLYPQGYGMASSNHSSIGVPTRQLGPTNPPIDIHPSNESIDAAIGDVISKPWLPLPLGLKPPSVDGVMTELQRQGVSNVPPLP

SEQ ID NO: 67 - DNA, 1221 bp, Arabidopsis thaliana
  CDS (46)..(1119): G725
cctctttcagagagagaaagagagtcagagagagagagagagagaatgttccatgctaagaaaccttcaagtatgaatggttcatatgagaacagagctatgtgcgttcaaggcgattcaggccttgtcctcaccaccgaccctaaaccgcgtttgcgttggaccgtcgaactccacgagcgttttgtggacgccgtcgctcagctcggcggccccgacaaagcgaccccaaagacgattatgagagttatgggtgtgaagggtcttactctttaccacctaaagagccatcttcagaaattcaggcttggaaagcagccgcacaaggagtacggagatcactccacaaaggaaggttcaagagcttctgccatggatattcagcgcaacgtagcttcttcttctggcatgatgagtcgcaacatgaatgagatgcaaatggaagtgcagagaaggttgcatgaacagctagaggtgcaaagacatctgcaactgaggattgaagcacaaggaaagtacatgcaatctatcttggagagagcttgccaaaccctagccggtgagaacatggcagccgccaccgcagcagccgccgtcggaggaggatacaagggtaatctgggaagttcgagtctttcagcagcggtgggcccacctcctcatcctcttagtttcccgccgtttcaagacctaaacatctatggaaacacaaccgaccaagtcctcgaccatcacaacttccatcatcaaaacatagagaaccatttcacgggtaacaatgctgcagacaccaacatttacttggggaagaagcgacctaatcctaattttggtaacgatgtaaggaaaggactattgatgtggtctgatcaagatcacgatctttccgcaaaccaatcgatcgatgatgagcatagaattcagatacagatggctacacatgtctccacggatttggattctttgtcggagatctacgaaaggaaatcaggtttatcaggtgatgaagggaataatggtgggaaattactggaaaggccatcgcctaggagatcaccattgagtcctatgatgaaccctaatggtggattaatacaaggaagaaactcgccatttgggtgatacaatttattaatttttatctatgagtgatgcatgggaatgtaagaacgagatatatatgttttgtcattgtgagtttgacgtagggtttagagaaaa

SEQ ID NO: 68 - protein, 358 aa, Arabidopsis thaliana
  G725
MFHAKKPSSMNGSYENRAMCVQGDSGLVLTTDPKPRLRWTVELHERFVDAVAQLGGPDKATPKTIMRVMGVKGLTLYHLKSHLQKFRLGKQPHKEYGDHSTKEGSRASAMDIQRNVASSSGMMSRNMNEMQMEVQRRLHEQLEVQRHLQLRIEAQGKYMQSILERACQTLAGENMAAATAAAAVGGGYKGNLGSSSLSAAVGPPPHPLSFPPFQDLNIYGNTTDQVLDHHNFHHQNIENHFTGNNAADTNIYLGKKRPNPNFGNDVRKGLLMWSDQDHDLSANQSIDDEHRIQIQMATHVSTDLDSLSEIYERKSGLSGDEGNNGGKLLERPSPRRSPLSPMMNPNGGLIQGRNSPFG

SEQ ID NO: 69 - DNA, 1262 bp, Arabidopsis thaliana
  CDS (61)..(1092): G1039
caagatttatgttttcgtaactgtaactcatagcaaaaacgagtctaagatctgttcataatgatgatgttcaagagcggtgacatggattacacccagaaaatgaagagatgtcacgaatatgtagaagctctagaagaagaacaaaaaaagattcaagtctttcaacgtgagctccctttatgtttagaacttgtaacccaagctatcgagtcatgtcggaaggagttatcggaatcttcagaacatgttggcggccagtcagaatgttctgagcggacaactagtgaatgcggcggtgccgtgtttgaagagtttatgccaatcaagtggagttctgcttcatctgatgaaaccgataaagatgaagaagctgagaaaactgagatgatgaccaatgaaaataacgatggtgataagaagaaatcggattggcttagatctgttcaattgtggaaccaatcaccagatccacaacctaataataagaaaccgatggtaattgaagtcaaacgcagcgctggtgcgtttcaaccgtttcaaaaggagaaacctaaggctgcagattctcaaccacttattaaagcaattactccgacgtcgacgacgacaactagttccacggcggaaaccgtcgggggtggaaaagagtttgaggagcagaaacaatctcattcgaataggaagcaaagacgttgctggtcaccggagttacaccgcagattcttgcacgcgcttcaacaacttggtggatcacatgttgctacgcctaagcagattagagatcttatgaaggtcgatggtttaactaatgacgaagttaaaagtcatttacagaaatatagattgcatacaagaagaccagctactccggtagtaaggaccggtggtgaaaatccacaacaacggcagtttatggtgatggaaggcatttgggtaccttcacacgatacaactaataatagagtttacgctcctgtggcgacacaaccgccgcaatcttcaacgtcgggagagagaagcaatcggggttgcaaatctcccgcaacatcttctactactacacacacaccacaccttcttcctctttcataaatatatagttaccgatttgtatgaaaatttgttttcttctttatatatttgttttgtaaccaagaatgttcgttctaggtttaagagttttgaataaattgtaacaatagatatacattgcacacaattgaataaaagaaaaagttttgataaaaaaaaaaaaaaaa

SEQ ID NO: 70 - protein, 344 aa, Arabidopsis thaliana
  G1039
MMMFKSGDMDYTQKMKRCHEYVEALEEEQKKIQVFQRELPLCLELVTQAIESCRKELSESSEHVGGQSECSERTTSECGGAVFEEFMPIKWSSASSDETDKDEEAEKTEMMTNENNDGDKKKSDWLRSVQLWNQSPDPQPNNKKPMVIEVKRSAGAFQPFQKEKPKAADSQPLIKAITPTSTTTTSSTAETVGGGKEFEEQKQSHSNRKQRRCWSPELHRRFLHALQQLGGSHVATPKQIRDLMKVDGLTNDEVKSHLQKYRLHTRRPATPVVRTGGENPQQRQFMVMEGIWVPSHDTTNNRVYAPVATQPPQSSTSGERSNRGCKSPATSSTTTHTPHLLPLS

SEQ ID NO: 71 - DNA, 1281 bp, Arabidopsis thaliana
  CDS (8)..(901): G1435
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 72 - protein, 298 aa, Arabidopsis thaliana
  G1435
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 73 - DNA, 1453 bp, Arabidopsis thaliana
  CDS (43)..(1152): G1490
attcatcagggccctgtgttctctgagtcaagtcaggaactgatgaataaccctgtaccgtgtcagtcggtctctggtggcaattctggtggttatttgtttccttcttcctctggatactgcaatgtttcagctgtcttgcctcatggaaggaatttgcaaaaccagccacctgtttccaccgtgcctagagacagattggctatgcaggattgtcctttgatagctcaatcctcgttgattaatcatcaccctcaagagttcatagatccacttcatgagttctttgatttctctgatcatgttcctgttcagaatctacaagcagagagtagtggagtaagggtggactcatccgtggaacttcataagaaaagtgaatggcaagattgggcagatcagctgatttctgttgacgatggttctgagccaaattggtctgaacttcttggagattcaagttcccacaatccaaattcagagatacctacaccatttttggatgtaccaaggctagatataacagctaaccagcagcaacagatggtttcatcagaggaccagctcagcggcagaaactcatcatctagtgtagcaacatctaaacaacgtatgcgttggacaccagaacttcacgaggcattcgttgaagctgttaatcagcttggtggtagtgaacgagccacccctaaggctgttttgaagctcttgaataaccctggcttgaccatttatcatgtaaaaagccatttgcagaaatatagaacggcaaggtataaaccggagacttcggaagttacaggagaacctcaagagaagaagatgacatctattgaagatatcaaatctcttgacatgaaaacgagcgttgagatcacacaagctctacggttacaaatggaagtgcagaaacgtctccacgagcagctcgagatccaacggtcactgcagttacagattgaaaaacagggccggtacctacagatgatgttcgagaaacaacaaaagatacaagacaacaagagctcttcttcagaagcatcaccaaagcaatgcaatggttcatttgcagaagttgaagttggtcttgagacactaacaggggaccaaaatgaatctgcttcagcatcaaggaaacgtgtcagagaagattaaagcatgtttaatttgatctcgtttgacgaaacatgtttattgggaattaattgtggaaaccaactccagttttgttaaaagaatctgtttctttcttagctctgtattgttctagtttagaagcagttgatttggccttgcatggctgcaacactaactaaagagtaaagactaattgtgtatatctacatatacatttttggggacgatttgtgtcgaaaaatcctttttcaatttttgatattgtatgtttagtccctacaaaatcaatcagacaagatattttctttaggacaaa

SEQ ID NO: 74 - protein, 370 aa, Arabidopsis thaliana
  G1490
MNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 75 - DNA, 1214 bp, Arabidopsis thaliana
  CDS (62)..(1069): G395
agatcttcttgttcctctctctcaatctctctctctaaaactcttattttcttcgtaagagatggaactagcgttgtctctaggcgacaatactaagaaacagttctcttttatggagaagaactcgaagattaataatccctctgtctcgtcgacatctacttccgagaaggatcttgggttctgcatggctttagatgttgcttttggtggtcacagatcgttgtcatcctcttcgtctccgtcggtagaggatgagaagaagaaaccggcgcccagagcaaaaaaatctgacgaatttagggtttcgtcttctgtagatccaccattacagcttcagcttcacttccctaattggctccctgagaacagtaaaggtcgacaaggaggaagaatgcccttaggagcagctacggttgtggaggaggaagaggaggaggaggaagcggtgcctagtatgtcagtatcgccgccggatagtgtaacgtcgtcgtttcaattggactttgggattaaaagttatggttatgagagaagaagcaataagagagatattgatgatgaagtggagagatcagcttcaagagccagcaacgaagacaacgatgacgagaatggatccactaggaagaaacttagactctccaaagaccaatctgcttttcttgaagacagcttcaaagaacacagtacccttaatcctaaacagaagattgcattggcgaagcagttgaatcttcgtcctcgtcaggttgaagtctggtttcaaaacagacgagccaggacaaagctgaagcaaacggaagtggactgtgaatacctaaagagatgctgtgagtcactaaccgaagaaaaccggaggcttcaaaaagaggttaaagaattgagaaccttgaagacttccacacccttttacatgcaacttccggccactactctcactatgtgcccttcttgtgaacgtgttgccacttcagcagcacagccctccacgtcagctgcccacaacctctgtttgtccacgtcatcattgattccggttaagcctcggccggccaaacaagtttcatgaaagcacctgcgaaatacagtttgagcaaacggtcgagctagagtggttttaaaagttgtcttcttgtgtatatatttattttacttttcatattttattagagaccgctattttgaaagacgaatagattgattatccggtt

SEQ ID NO: 76 - protein, 336 aa, Arabidopsis thaliana
  G395
MELALSLGDNTKKQFSFMEKNSKINNPSVSSTSTSEKDLGFCMALDVAFGGHRSLSSSSSPSVEDEKKKPAPRAKKSDEFRVSSSVDPPLQLQLHFPNWLPENSKGRQGGRMPLGAATVVEEEEEEEEAVPSMSVSPPDSVTSSFQLDFGIKSYGYERRSNKRDIDDEVERSASRASNEDNDDENGSTRKKLRLSKDQSAFLEDSFKEHSTLNPKQKIALAKQLNLRPRQVEVWFQNRRARTKLKQTEVDCEYLKRCCESLTEENRRLQKEVKELRTLKTSTPFYMQLPATTLTMCPSCERVATSAAQPSTSAAHNLCLSTSSLIPVKPRPAKQVS

SEQ ID NO: 77 - DNA, 2146 bp, Arabidopsis thaliana
  CDS (192)..(1961): G780
agaaaataggggcaagatctgagatctctgggtgttccatgcaaaactgttatactccgccgtatatttgcatctgggtcacacttctaaaccctatcatttgacttaagaatcgatttctgaagatctgggtttcttaaaagtctttcctttttgttgggatccaaacaacaaaagaaaagaaagcagagatgaatattggtcgcctagtgtggaacgaggacgataaagcgattgttgcgtcattactgggcaaacgagctctcgattacttgctttccaactctgtttccaatgctaatctcttgatgactctaggaagcgacgagaatctgcagaacaagctctcggatctcgtcgagagacccaacgcttctaatttctcttggaactacgccattttctggcagatttccaggtcaaaggccggagatttggttctctgttggggcgatggatattgcagagagcctaaagaaggagagaaatcagagatcgttaggattctaagtatgggaagagaagaagaaacgcatcagactatgagaaagagagtattgcaaaagcttcatgatttgtttggtggctcagaagaagagaactgtgctttaggactagatagagttactgacactgagatgtttcttctttcttctatgtatttctcattccctcgaggtgaaggtggtccaggcaagtgttttgcctctgctaaacctgtttggttatccgatgtcgtcaattcgggttctgattattgcgttagatcgtttcttgctaaatctgctggcattcagactgttgttttggttcctactgatcttggtgttgttgagttaggctcaacttcatgtttgcctgaaagtgaagactcaatcttgtctataagatcattgtttaccagtagtttgcctccggttagagctgttgctttacctgttactgtagctgaaaagattgatgataacagaacgaagatattcggcaaggatttgcacaattcagggtttcttcaacatcatcagcatcaccaacaacaacaacaacaaccaccgcaacagcaacagcatagacagtttagagagaaactcacggttagaaaaatggatgatagagctcccaagagattagatgcttatccgaataatgggaacaggtttatgttttcgaacccaggcaccaacaacaacactcttctgagtcctacttgggttcaacctgagaactacacgaggccaatcaacgtgaaggaagttccaagcacggatgagttcaagtttttacctttgcagcaatcatcgcagaggctgcttcctcctgctcaaatgcagatagatttctctgctgcgagttcaagggcttcagagaataattcagatggagaaggaggaggggaatgggcagatgcagtgggtgctgatgaatctggtaacaacagaccaagaaaacgcggaaggagacctgccaacggaagagcggaagctttgaaccatgtagaagcagagaggcagaggcgtgagaagcttaaccagaggttttacgctctgagatccgttgttcccaacatatccaagatggacaaagcgtccttgttgggagacgcggtttcttatataaacgagcttcacgcgaagctaaaggtcatggaagcagagagagagaggttagggtatagctcaaatccacctatcagcttggattcagatataaatgttcaaacctcaggtgaagatgtcacagtgaggataaactgtccgttggagtctcatccggcttccagaatcttccatgcgtttgaagagagtaaagtagaagtgataaactcgaacctggaagtttctcaggacacagtgttgcatacgtttgtagtcaaatctgaagaattaacgaaagagaagctgatatcggccttgtctagagagcaaacaaattcagttcagtcaagaacatcatcaggtagatagccttttgagagacagaagaaggtggaagtaagtttgtaatcaagaaccggttttgaatggttcttttttttcttctaggtatcttttgtttttacctttttttggttatatacctgtaagaatcctccaaactaggattttagaagttttattgacaaaagtagacattatcatttagaaaa

SEQ ID NO: 78 - protein, 590 aa, Arabidopsis thaliana
  G780
MNIGRLVWNEDDKAIVASLLGKRALDYLLSNSVSNANLLMTLGSDENLQNKLSDLVERPNASNFSWNYAIFWQISRSKAGDLVLCWGDGYCREPKEGEKSEIVRILSMGREEETHQTMRKRVLQKLHDLFGGSEEENCALGLDRVTDTEMFLLSSMYFSFPRGEGGPGKCFASAKPVWLSDVVNSGSDYCVRSFLAKSAGIQTVVLVPTDLGVVELGSTSCLPESEDSILSIRSLFTSSLPPVRAVALPVTVAEKIDDNRTKIFGKDLHNSGFLQHHQHHQQQQQQPPQQQQHRQFREKLTVRKMDDRAPKRLDAYPNNGNRFMFSNPGTNNNTLLSPTWVQPENYTRPINVKEVPSTDEFKFLPLQQSSQRLLPPAQMQIDFSAASSRASENNSDGEGGGEWADAVGADESGNNRPRKRGRRPANGRAEALNHVEAERQRREKLNQRFYALRSVVPNISKMDKASLLGDAVSYINELHAKLKVMEAERERLGYSSNPPISLDSDINVQTSGEDVTVRINCPLESHPASRIFHAFEESKVEVINSNLEVSQDTVLHTFVVKSEELTKEKLISALSREQTNSVQSRTSSGR

SEQ ID NO: 79 - DNA, 1201 bp, Arabidopsis thaliana
  CDS (75)..(950): G784
ctcggacaaagctgaaatccctaaagaaaaaacacttctccaaacttttcatctccgatatctctttaactaacatgtcgaataatcaagctttcatggaattgggatggagaaacgacgtcggatcacttgctgtgaaagatcagggcatgatgtcagaaagagcaagaagtgatgaagatcgtctaatcaacggtctaaaatggggctacggctactttgatcatgatcaaactgataattatcttcagattgttccagagattcataaagaagtagaaaatgcgaaggaggatttattggttgttgtccctgatgaacattctgaaactgatgatcatcatcatattaaagatttttcagagagatcagatcatcgattttatctgagaaacaaacatgagaaccccaaaaaacgtcgtatccaggtcttaagtagtgatgatgaatcggaggagtttacaagagaagttccttcagttactcgaaaaggttccaagagaagaagaagagacgagaagatgagtaataagatgcgtaagctacagcaactcgtacctaattgtcacaagacggacaaggtttcggttctcgacaagaccatagagtatatgaaaaaccttcaacttcaacttcagatgatgtcaacagtgggggtgaatccttattttcttccggcgacattaggatttggaatgcacaaccacatgctgacggcaatggcttcggctcacggcctaaatccggcgaatcacatgatgccatcgccgctaattccggcgttaaattggccattaccaccgtttactaatatttcattcccacattcatctagtcaatctctatttcttacaacatcatcaccagcttcttctcctcagtctcttcacggtttggttccttatttcccaagtttcttggatttttcttcccatgcgatgagaagactatgataagtaagtagctcgataaaagtttatgtgaaatgatcgttgactaattaagagagaaaagagttccaaattaggacagtttgtgtgaaccatttgtgtcatatacttttttttccgggtggttttgtatattaataataatcaataagttaaaactttttgtataaattcttgcatgtaacaatttttttcatttatctgatattttgtaaaatatattgagacatgcttataagagcaaaaaaaaa

SEQ ID NO: 80 - protein, 292 aa, Arabidopsis thaliana
  G784
MSNNQAFMELGWRNDVGSLAVKDQGMMSERARSDEDRLINGLKWGYGYFDHDQTDNYLQIVPEIHKEVENAKEDLLVVVPDEHSETDDHHHIKDFSERSDHRFYLRNKHENPKKRRIQVLSSDDESEEFTREVPSVTRKGSKRRRRDEKMSNKMRKLQQLVPNCHKTDKVSVLDKTIEYMKNLQLQLQMMSTVGVNPYFLPATLGFGMHNHMLTAMASAHGLNPANHMMPSPLIPALNWPLPPFTNISFPHSSSQSLFLTTSSPASSPQSLHGLVPYFPSFLDFSSHAMRRL

SEQ ID NO: 81 - DNA, 1585 bp, Arabidopsis thaliana
  CDS (72)..(1403): G789
gtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaactggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacaagttgaattatagtatcaatcaagtgttgg

SEQ ID NO: 82 - protein, 444 aa, Arabidopsis thaliana
  G789
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNWSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 83 - DNA, 1107 bp, Arabidopsis thaliana
  CDS (173)..(874): G791
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 84 - protein, 234 aa, Arabidopsis thaliana
  G791
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 85 - DNA, 1008 bp, Arabidopsis thaliana
  CDS (110)..(787): G792
  "n" bases represent variable nucleotides
tcttttttcttccgtttttccacacattgtctctacctttccctttttcagatttgaccctttgttttcaaaagaaacgatttttagtagccgccggggaatcaggagaatggtgtctccggagaatacgaactggcttagtgattaccctttgattgaaggtgctttctctgatcagaaccccactttcccttggcagatagatggctcagctactgtcagtgttgaagtggatggcttcctttgtgatgcagatgtgatcaaagaaccaagttcaaggaagaggatcaaaactgaatcttgcactggttctaactcgaaagcttgtagggagaaacaaagacgtgatagactaaatgacaagtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaaagctgctgcttctctctactactattaacggttctgtaagattacttcttacgcgcttttttctgatgtaatgattctcacattctgtgattggtgacatagtccactgcaacttaaaatgtaaaattgaaataagcttgcactaaaaatcaaatctcattgtgcaaaaagttggataatttggaaatcattgttttacaaananaaaaccccccgng

SEQ ID NO: 86 - protein, 226 aa, Arabidopsis thaliana
  G792
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 87 - DNA, 1313 bp, Arabidopsis thaliana
  CDS (40)..(1089): G1061
caaaaaaaagtgtagaagcagaagaaacccatcatcatcatgatgaactcttctcttctaactccttcttcttcatcttcttcccatatccaaactccatcaacaactttcgaccacgaagacttcctcgatcaaatcttttcctcggccccgtggccctccgtcgtcgatgatgctcatcctcttccctccgatggcttccacggccacgatgtcgactcaaggaatcagccgatcatgatgatgcctttgaatgatggctcctccgtccacggtctttataatggcttctccgtcgccggatctcttcctaactttcaaatccctcagggatcggagggaggattgatgaaccaacaaggacaaacgcaaacgcaaacgcaacctcaggcgagcgcgtctacagctactggcggtacggtggcggctccgccgcagagtaggactaaaatccgagctaggagaggtcaagcaactgatcctcatagtatcgccgaaaggttacgaagagagagaattgcggaaagaatgaaagctcttcaagaactcgttcctaacggcaataagacagacaaggcatcgatgctcgatgagatcatagattatgtcaagtttttacaactccaagtcaaggtactgagcatgagcagattgggaggtgctgcttccgtttcttctcaaatctccgaggctggtggatcccacgggaacgcatcctccgccatggtcggcggtagccagacggccggaaactccaacgacagcgttacaatgacggaacatcaagtggccaaactaatggaagaagacatgggctcggccatgcaatatcttcaagggaaaggtctttgtctcatgccaatctctttagccaccgccatctcaaccgccacgtgtcactcccgtaaccctttgatccctggagctgttgccgacgccggaggtccttcccctcccaatctttctgccatgaccatacagtcgacgagtacaaaaatgggtagcggtaatgggaaattaaacggtaacggcgtgaccgagaggtcgtcttctatcgccgttaaagaggccgtatccgtttcgaaagcgtgataacggccgtttacttttggggttaggcagagagataccaaaaacaaagagaaagtggggtgaagtgggagataaagtcaaagtctacgaagaatgaggttgaggttgtttgatgtgttctctcaacgaagccatatttttcgtagagttttggttcttttacctacgcactacaaaaccactcaagggacatttctttttcttttttaaatatatggtgc

SEQ ID NO: 88 - protein, 350 aa, Arabidopsis thaliana
  G1061
MMNSSLLTPSSSSSSHIQTPSTTFDHEDFLDQIFSSAPWPSVVDDAHPLPSDGFHGHDVDSRNQPIMMMPLNDGSSVHGLYNGFSVAGSLPNFQIPQGSEGGLMNQQGQTQTQTQPQASASTATGGTVAAPPQSRTKIRARRGQATDPHSIAERLRRERIAERMKALQELVPNGNKTDKASMLDEIIDYVKFLQLQVKVLSMSRLGGAASVSSQISEAGGSHGNASSAMVGGSQTAGNSNDSVTMTEHQVAKLMEEDMGSAMQYLQGKGLCLMPISLATAISTATCHSRNPLIPGAVADAGGPSPPNLSAMTIQSTSTKMGSGNGKLNGNGVTERSSSIAVKEAVSVSKA

SEQ ID NO: 89 - DNA, 1967 bp, Arabidopsis thaliana
  CDS (297)..(1778): G1062
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaactaaaaaaaaaaaaaa

SEQ ID NO: 90 - protein, 494 aa, Arabidopsis thaliana
  G1062
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 91 - DNA, 1600 bp, Arabidopsis thaliana
  CDS (104)..(1081): G1133
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggaccaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaagaaccaaaaaaaagtcactttcttctgtgcttggagtggaagaaaagtgaaagaagggaaaaaagcaaagtcttggtgctcattgatcgttaataattatctttactcgtgagtaataataatatctctgtgaaggtctggtggtggtgggtgtggatgaaaaaaaatcaaaaaggcaaatattgaaatttttggagtggttgtgacttgtggaaattgaaatcttcccactttcattaggggaaaatctatgtccccactctctcttggctcattat

SEQ ID NO: 92 - protein, 326 aa, Arabidopsis thaliana
  G1133
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 93 - DNA, 1064 bp, Arabidopsis thaliana
  CDS (61)..(846): G1134
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 94 - protein, 262 aa, Arabidopsis thaliana
  G1134
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 95 - DNA, 1564 bp, Arabidopsis thaliana
  CDS (28)..(1377): G1664
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 96 - protein, 450 aa, Arabidopsis thaliana
  G1664
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 97 - DNA, 3829 bp, Arabidopsis thaliana
  CDS (241)..(3498): G447
  "n" bases represent variable nucleotides
ctttttaagagcttaaaaatttgctttgaagcttcaaatattcttatgaactaaaaagaagaaaaaagcttttgtttctttttccttagcagcagaatgatttttgtttccaaaattattactatttagtttctctcgtgctcttctcttgagcaaatacagattcgttaattttgctgaagaagaagaactctgtttcttccctgcaccaaaccaattttttcgttctttctataaaccatgaaagctccatcaaatggatttcttccaagttccaacgaaggagagaagaagccaatcaattctcaactatggcacgcttgtgcagggcctttagtttcattacctcctgtgggaagtcttgtggtttacttccctcaaggacacagcgagcaagttgcagcatcgatgcagaagcaaacagattttataccaaattacccaaatcttccttctaagctgatttgcttgcttcacagtgttacattacatgctgataccgaaacagatgaagtctatgcacaaatgactcttcaacctgtgaataagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgatttctcgatgcaaccgcctgcgcaagagattgtagctaaagatttacatgatactacatggactttcagacatatctatcgaggccaaccaaaaagacacttgcttaccacaggttggagcgtttttgttagcacaaagagactatttgcgggtgattcagttttgtttgtaagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaggatgggatgaatcaacagctggagataggccaagccgagtatccatatgggaaatcgaacccgtcataactcctttttacatatgtcctcctccatttttcagacctaagtacccgaggcaacccgggatgccagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagntctcagtcatttggtattcccagcattccctttaagcccggatgttcaaatgaggttggcggcatcaatgattcaggaatcatgaatggtggaggactgtggcccaatcagactcaacgaatgcgaacatatacaaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggaagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaacttacattatcattcgaggccatcgcaaagtacatgtttttttttgtgtgtatgtactgcaaacaacaaactgagaagaagaagatactgcacggtatataaacatttttataggacagtgatttgatttttcattctaacttgatgttgttgtactttcttgtttccatatttgtataacaagtataatgcttgacaagtctatgaggagcatatcttatacagagatactaagatgtaatgttaatgtaactaaacaattaccttcattaatcatgaatcctttggtcgtttaaaa

SEQ ID NO: 98 - protein, 1086 aa, Arabidopsis thaliana
  G447
  "Xaa" represents a variable amino acid
MKAPSNGFLPSSNEGEKKPINSQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEPVITPFYICPPPFFRPKYPRQPGMPDDELDMENAFKRAMPWMGEDFGMKDAQSSMFPGLSLVQWMSMQQNNPLSGSATPQLPSALSSFNLPNNFASNDPSKLLNFQSPNLSSANSQFNKPNTVNHISQQMQAQPAMVKSQQQQQQQQQQHQHQQQQLQQQQQLQMSQQQVQQQGIYNNGTIAVANQVSCQSPNQPTGFSQSQLQQQSMLPTGAKMTHQNINSMGNKGLSQMTSFAQEMQFQQQLEMHNSSQLLRNQQEQSSLHSLQQNLSQNPQQLQMQQQSSKPSPSQQLQLQLLQKLQQQQQQQSIPPVSSSLQPQLSALQQTQSHQLQQLLSSQNQQPLAHGNNSFPASTFMQPPQIQVSPQQQGQMSNKNLVAAGRSHSGHTDGEAPSCSTSPSANNTGHDNVSPTNFLSRNQQQGQAASVSASDSVFERASNPVQELYTKTESRISQGMMNMKSAGEHFRFKSAVTDQIDVSTAGTTYCPDVVGPVQQQQTFPLPSFGFDGDCQSHHPRNNLAFPGNLEAVTSDPLYSQKDFQNLVPNYGNTPRDIETELSSAAIXSQSFGIPSIPFKPGCSNEVGGINDSGIMNGGGLWPNQTQRMRTYTKVQKRGSVGRSIDVTRYSGYDELRHDLARMFGIEGQLEDPLTSDWKLVYTDHENDILLVGDDPWEEFVNCVQNIKILSSVEVQQMSLDGDLAAIPTTNQACSETDSGNAWKVHYEDTSAAASFNR

SEQ ID NO: 99 - DNA, 1239 bp, Arabidopsis thaliana
  CDS (194)..(994): G467
ggttgcttcaagagttttggatagtgtagcagagagattttaactaatgggtttataaaattttgttcttttgcgtgaacaagttgtcaacttctagacagattttctttttgaagtgttttcttgtcgaaattcttcttcttttggtcaaagaacgcaagattcttctgtagttcctctaaaaaaaatcctaatggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagttgtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatgaagaaaaagatcttttacagcttttaaagaagtagagagatgttattaattgcattttgcctttaaactttgatgagtttttggtcttggaaaagtttctgatataagtctgatgtacattctggtttgttacatcttcttttggcttttgagatatcatagagttttgttggaactcaaagaccaaacagtgcaatgatgattttggggtcttgagtaaatttacaaacccttttaggcaaa

SEQ ID NO: 100 - protein, 267 aa, Arabidopsis thaliana
  G467
MEGYSRNGEISPKLLDLMIPQERRNWFHDEKNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 101 - DNA, 2299 bp, Arabidopsis thaliana
  CDS (271)..(2076): G716
  "n" bases represent variable nucleotides
aaaaaaaaaggggagagatttagttttatccnncagngcctgaantacgttctgcaatcaanacggacataaccgnccgttgtgtcctgtttataaagttttgctttttttattttctccantgatgggtcttttctttcttctctctctngtgtttctttcatggggttaagactagtgtttaccgcgtgaaggtttttttttctttctattttctttcatttcctctccttctacttcttcttctccagttctcatctgggttcttcaatggcgagtgttgaaggtgatgatgatttcggaagttcttcgtcaaggtcttatcaagatcaactatacacagagctatggaaagtttgtgcaggtccattagtggaagttcctcgtgctcaagagagagttttctacttccctcagggtcacatggaacaacttgtggcgtcaactaatcaaggaatcaattcagaagaaatacctgtttttgatcttcctccaaagatactttgtcgagttcttgatgtcactttaaaggcggagcatgaaacagatgaggtttacgctcagatcacattacaaccagaggaagatcaaagtgaaccaacaagtcttgatccacctattgttggaccaactaagcaagagtttcattcgtttgttaagattttaacggcttcagatacaagcactcatggtggattctctgttcttcgtaaacacgccactgaatgcttgccttctttggatatgacacaagctactcctactcaagaacttgtgactagagatcttcatggctttgaatggaggtttaagcatatattcagaggacaaccacggaggcatttgcttactacgggttggagtacatttgtatcctcgaaaagacttgtagctggagatgcttttgtgttcttgaggggtgagaatggggatttacgggttggagtgagacgattagctcggcatcaaagcacaatgcctacttcggttatttcaagtcagagcatgcatttgggagttcttgctacagcttctcatgctgtgcgtacaacaacaatctttgttgtcttttacaagcctaggataagccaattcatagttggggtgaacaagtatatggaagctataaagcatggattttctctcggtacccgattcagaatgaggtttgaaggagaagagtctcctgagagaatatttactggtacgattgtgggaagtggagatctatcttcacaatggccagcttctaaatggaggtcattgcaggtacaatgggatgagccaacaacagttcagagaccagataaagtctcaccatgggagatagagcctttcttggcaacttccccaatttcaactcctgctcaacaaccacaatcgaaatgcaagcggtcaagacccatcgagccatcagttaaaacaccagccccacctagtttcttgtacagcctccctcagagccaagattccattaatgcatcccttaaactgtttcaagatccatcacttgagagaatttcaggtggatactcctcaaacaacagcttcaaacccgagactcctcctcctccaacgaattgtagctataggttgtttggatttgatctcacaagcaattctcctgctccaatccctcaagacaagcaaccgatggatacttgtggagctgccaagtgtcaagaacccatcactccaacctcaatgagtgagcagaagaagcaacaaacatcaagaagtcgaactaaagtgcaaatgcaaggcattgcggttggtcgtgcggttgatttaacactgttgaaatcttacgatgaactgattgatgagcttgaggagatgtttgagattcaaggacagcttcttgcccgagacaaatggatcgttgtcttcactgatgatgaaggagatatgatgcttgctggtgatgatccgtggaatgagttttgcaagatggcaaagaagatatttatatattcgagcgatgaggttaagaaaatgacaacgaaactgaagatttcttcgtcgttagagaatgaggaatatggtaatgaatcattcgaaaatcgtagtagggggtgagagttttagctgttaattaaggttaattcggcgacgtcgttttagtgcgtaagtgtctaaagactttttttttagtctgtgtatataaagtcttgtcctctttttcatgtcaatttttcaagttggcgatttaatatttcggttttgggacagtggttgatggggcggttttacattttttatgtgtatgtacttgttccaaaaccattcaattttcaaa

SEQ ID NO: 102 - protein, 602 aa, Arabidopsis thaliana
  G716
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 103 - DNA, 789 bp, Arabidopsis thaliana
  CDS (6)..(530): G991
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 104 - protein, 175 aa, Arabidopsis thaliana
  G991
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 105 - DNA, 1072 bp, Arabidopsis thaliana
  CDS (152)..(964): G1267
  "n" bases represent variable nucleotides
aagtagagaataataatcacatcaagattgtttataaccctccccntaatcaccttcttantnaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcatttttttaaaaaaaaaaaaaaaa

SEQ ID NO: 106 - protein, 271 aa, Arabidopsis thaliana
  G1267
MHRRAAIQESDDEEDETYNDVVPESPSSCEDSKISKPTPKKRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 107 - DNA, 4529 bp, Arabidopsis thaliana
  CDS (265)..(4431): G1025
aaagtcagatgtccagcaggcttttgatgcatgtgattctcttcttgagaatacaagcagatttggaaaaaagagtatgattcatgtcatgtcttggttgaggccagaggtaatgacatcagaggctaggtatgggcaagattcaacgtcaaggatattgagtcatcagttgtgacggaagatgaaactttggactctagtaagcagtctagttttgatgctgctgctttttatgaagccataaagccatcaaagacggatgcaatgcttggagatgacatagctgatttgctcccagaacttaggccgtaccaacgacgggcagcttattggatggttcagcgagagagaggcgatccaataacgttgggagacaaggaagacaaccaattcatttcacctttgtctatctccgtgggattccttgactctgctacaaaaatgttcttgaacccattcagtgggaatatctcattgacaccagagtatttttcacctcgaattcagggcggtatccttgctgatgaaatgggattgggaaaaacggtggaactacttgcttgtatcttttctcatcgaaaaccagcggaggatgaaatttctgtgtctaatggttcatcagttactgatgttttgaacgctggcttgagaagattgaaaagagaacgtgttgagtgcatatgtggagctgtcagtgaaagtcacaaatacaaaggagtttgggtacagtgtgacctttgtgatgcttggcagcatgccgactgtgtaggttattcacctaaagggaaaggtaagaaggatagtcaacatattgatgaaaaagcgtctcaaaagaagagcaaaaaggatgcaacggaaattattgtcagagaaggtgaatatatttgccaaatgtgctcagaacttctacaagtcactgcctctcccatctctacgggtgccactcttattgtctgtccagctcctatattaccgcaatggcattccgagattacacgccatacacgcttgggatctctcataacatgtatctatgaaggtgtgaggaacgcctcactttctgaagaacctatgattgacattactgaacttctcaatgcggacattgttttaactacgtatgatgtccttaaagaggacttgacacatgacttcgacaggcatgatggtgaccggcactgtcttagattccagaaaaggtaccctgttattccgactccactcaccagaatattttggtggaggatttgtttggatgaggcccagatggtggagagcaatgcagctgctgcaacagagatggcgttgagattatacaccaaacaccgttggtgtatcaccggaactcctatacaacgcaaacttgatgacttatttggactattgaagtttcttagagcaaatcctttcgatgtttcaagatggtggattgaagttataagagacccatatgagaggcgagacacaaaggccatggaatttacgcataagtttttcaaacaagttatgtggcgttcttcaaaagtccatgtggctgatgagttgcaacttccacctcaagaggaatgcgtctcgtggcttaaattttccgcaattgaagaacacttttacagtagacagcatgacacttgtgtgagttatgctcgtgaagttatagaaactttgaaacgtgatattctcaaaagaggtcatacttcttctgataatcctttagtcactcatgctgaagctgcaaaactgttgaactcgctcttgaaattgcgccaagcttgctgccaccctcaagtaggaagttcaggtttacgctctttgcaacaaagtccaatgaccatggaagaaattttaatggtccttgtgaaaaagacccagagcgagggagaagaagctcttagagtgttaattgttgcattaaatgggattgctgctattgccatgcttaagcaagaattttctgaagctgtgtccttatacaaggaagcattaagtataactgaagaacacgccgaggattttcgtcttgatccattgttaaatattcacattcttcacaatttagctgagatactaccaatggccaaaagctacggtggaaaactttctgcatcaggaaggcctgaaacaaaaatagatgtaaaagatgatgatcatcatcgtgcatcgaagaggcaaaggatcaatgagctcgagagtttaactcatgattcttcagaaactgtacatcagcgggaagctattgctccagacaatggtttaaagaaggatggagagtgtcatgaagaatgcaaaactctggatatagtttgtgacacactgaaggttaagtatttatccgcattcaactcaaagctttctgcagcacagcacgaattcaaaaaatcatacaatcaggtttctgagtcgttgagcaatatggggaaacaacgttcagtttggtggttggatgccctgcaacttactgaacagaataaagacttctctagcgagttgacaaggaagattgaagaggccctccatggaaacttaaacaattcaagctcctccagagagagttctcgatttagaactatacatggcatgaaacttcatctgcagacgtgtatggatatgctggagagatctagaaagaaagtgatagataggattctagaaattgatcagactatggagaaaccaaagttggaggatattgagcgtattagcaactgcaagtattgcaataagaatagtgatggccccccgtgtattcattgcgagctagatgaactattccaggaatatgaggctaggcttttccgtcttaacaaatctcgcaggggagtaatggaaattgcggctgctgaagagacggtacatttgcagaagaagagagatgctcgtaatctttttttatttggtttatcatcaagaagcaaggatctaaatgcatcacgtggtgatgacgaggagccaaccaaaagaaatgctggtgacattgtggttctttcaaaatctccatctgagacggaaatagttcttggagtgataagaaaccattgcaaaactcatttagatagggaaagcaaattggcagctacaaaacatttgcatacccttgaggtgatgcgaaaggaatatgtacatgcaagggtcttagctagggatcaagctcaactcctacgtgcctatgatgagattaacatgtcaacaatgagactacagcttagagaatcggaagatgacacatcgatctatgctttgggccgggacgagttagatgttgctagtgtgctgaacacaaatgacaaatttatggctcaatcctcgttgcttagtataaaagggaaacttcgttatttgaagggtttgatgaaatccaaacagaaacaagaatccgagagtccagatctttcctcaccaatacatgaaacagtcgatgcttcggatcctgctgaacaggaaagcgaaaacctgcttaagagagatgaagcatgcccgatttgtcatgaaattctaaggaatcagaagatggttttccagtgcgggcattccacttgctgtaactgcttttttgctatgactgagcgcaaatcagttcaagaaacgctgcaaaagtgggtgatgtgtccaatatgcaggcagcatacagatgttagaaatattgcatatgctgatgatagaagaaacagttcttcgtcagatcaagatcacaaagacagtgaagcatcattggtggttcaaggttcatatggaacaaagattgaagctgttactagaagaatcttatggatcaagtcaagtgacccacaaacgaaggttcttgttttctccagctggaacgatgttcttgatgtgttggaacatgccttcgctgcaaatagcatcacctgcatccggatgaaagggggcaggaaatcacagacagccattagcaaattcaagggatctgagaaagaaacccaaaagacaaactcccatcaaaaagaggaaaaatcgattcaagtgttattgcttttggtgcagcatggtgccaacggtcttaatcttctagaagcacagcatgttattctggtggagccacttctaaatccagctgcggaagcgcaagctgttgggcgtgttcaccgaattggacaagagaagcctactctagttcatcggtttctggtatcgggcacagtggaagagagcatctacaaactgaacaggaataagaatacaaacttaagttcatttagcagcaggaatacaaagaatcaagatcaacagttcttgacactaaaagatcttgaatctctatttgcttcaccaacagcagaaacagcagagatggaacaaaacccaggagagagacaggagaatctgagagatctaccaccctcagtcgctgcagcattagcagccgagaggagaatgaaggaaagtaatgcatcctcatcaactacaaacgcatcatgactatggaaaaggttgcagagagattggttccagccaaatgtttgttggagcgtcttgttgtatgcacataagatggtgaagagagaagctgctcg

SEQ ID NO: 108 - protein, 1389 aa, Arabidopsis thaliana
  G1025
MLGDDIADLLPELRPYQRRAAYWMVQRERGDPITLGDKEDNQFISPLSISVGFLDSATKMFLNPFSGNISLTPEYFSPRIQGGILADEMGLGKTVELLACIFSHRKPAEDEISVSNGSSVTDVLNAGLRRLKRERVECICGAVSESHKYKGVWVQCDLCDAWQHADCVGYSPKGKGKKDSQHIDEKASQKKSKKDATEIIVREGEYICQMCSELLQVTASPISTGATLIVCPAPILPQWHSEITRHTRLGSLITCIYEGVRNASLSEEPMIDITELLNADIVLTTYDVLKEDLTHDFDRHDGDRHCLRFQKRYPVIPTPLTRIFWWRICLDEAQMVESNAAAATEMALRLYTKHRWCITGTPIQRKLDDLFGLLKFLRANPFDVSRWWIEVIRDPYERRDTKAMEFTHKFFKQVMWRSSKVHVADELQLPPQEECVSWLKFSAIEEHFYSRQHDTCVSYAREVIETLKRDILKRGHTSSDNPLVTHAEAAKLLNSLLKLRQACCHPQVGSSGLRSLQQSPMTMEEILMVLVKKTQSEGEEALRVLIVALNGIAAIAMLKQEFSEAVSLYKEALSITEEHAEDFRLDPLLNIHILHNLAEILPMAKSYGGKLSASGRPETKIDVKDDDHHRASKRQRINELESLTHDSSETVHQREAIAPDNGLKKDGECHEECKTLDIVCDTLKVKYLSAFNSKLSAAQHEFKKSYNQVSESLSNMGKQRSVWWLDALQLTEQNKDFSSELTRKIEEALHGNLNNSSSSRESSRFRTIHGMKLHLQTCMDMLERSRKKVIDRILEIDQTMEKPKLEDIERISNCKYCNKNSDGPPCIHCELDELFQEYEARLFRLNKSRRGVMEIAAAEETVHLQKKRDARNLFLFGLSSRSKDLNASRGDDEEPTKRNAGDIVVLSKSPSETEIVLGVIRNHCKTHLDRESKLAATKHLHTLEVMRKEYVHARVLARDQAQLLRAYDEINMSTMRLQLRESEDDTSIYALGRDELDVASVLNTNDKFMAQSSLLSIKGKLRYLKGLMKSKQKQESESPDLSSPIHETVDASDPAEQESENLLKRDEACPICHEILRNQKMVFQCGHSTCCNCFFAMTERKSVQETLQKWVMCPICRQHTDVRNIAYADDRRNSSSSDQDHKDSEASLVVQGSYGTKIEAVTRRILWIKSSDPQTKVLVFSSWNDVLDVLEHAFAANSITCIRMKGGRKSQTAISKFKGSEKETQKTNSHQKEEKSIQVLLLLVQHGANGLNLLEAQHVILVEPLLNPAAEAQAVGRVHRIGQEKPTLVHRFLVSGTVEESIYKLNRNKNTNLSSFSSRNTKNQDQQFLTLKDLESLFASPTAETAEMEQNPGERQENLRDLPPSVAAALAAERRMKESNASSSTTNAS

SEQ ID NO: 109 - DNA, 1120 bp, Arabidopsis thaliana
  CDS (32)..(955): G1212
caccagagacgactaatcaattcatctgattatggagagactacagagaatcttcggagctggtggcggtttaggtcacgcatcgcctgattctccgactctcgatacatcggagcaggtttacatctcttctctcgctctcctcaagatgcttaagcacggaagagctggtgttcctatggaagtcatgggattgatgcttggagagtttgtggatgaatacactgttagggttgtggatgtttttgcgatgcctcagagtggtactggtgttagtgttgaagctgttgatcatgttttccagactaatatgctcgacatgcttaaacagaccggaagacctgagatggtggttggttggtatcattcacatcctggattcggctgctggctttctggggttgacattaatactcaacagagttttgaagctttgaatcagcgagctgtagcagtggtggtagatccgattcagagtgtgaaaggaaaggtggtgattgatgcgttccgctccataaatccacagaccattatgcttgggcaggaaccccgtcaaacaacatcgaaccttgggcacttgaacaaaccatcgatccaggctttgattcacgggttgaacagacactattactcaatagcaatcaactataggaagaacgagcttgaggagaagatgttactcaacctccacaagaagaaatggacagatggtctgacgctaagacgctttgacacccactccaagaccaacgaacagacggtccaggagatgttgagcttggctgctaaatataacaaggcggttcaagaggaggacgagttgtcaccagagaagctggcaattgtgaatgtgggaagacaagatgcaaagaagcatctggaagaacatgtctcgaacctcatgtcatccaacattgttcagacactaggcactatgctcgacactgttgtcttctagagagcttacttctccagccgcttcaagtcattgagctttgttcttctgcatctctttggcttctactgaatgttctctttttatctgctagctttttacaaggttgtactgtactatgtgatttcgttcgttaagggcagggatcgatttcaaaaaaaaaaa

SEQ ID NO: 110 - protein, 308 aa, Arabidopsis thaliana
  G1212
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 111 - DNA, 1756 bp, Arabidopsis thaliana
  CDS (144)..(1580): G1219
ttagcccgggcagggcaaggagccaaaataaaaccattgaagctagcagcagccgaagaagcggtcacattttccggcaaaacagacagatcgaccagtgaaagctccaatctcttcctgaggcattgtgatctcttgttaaaatggctagtactctgaggaacattcatgataagagatctaattcgcaatctgagtctactggaaatggaggaagtaagataagaaatcttcatgacgaaacagatcaaaatgttattgcttcagaagacactgtataccgctacttgtgtcccgtgaaaaagaccgggagcattatcgggaaaggcggcgagattgctaagcagataaggtctgagactaaatcaaacatgaggataaacgaggctttacctggttgtgaggagcgtgttgttaccatgtattccactaatgaggagttgaatcattttggagatgatggtgagcttgtttgtcctgctttggatgctcttttcaaggttcatgacatggttgtagcggacgctgatcaagatgatggtactgatgatgataatgatcttggtgaaaagcaaacggtaaccgtgaggatgcttgtaccgtctgaccaaattggttgcgttattgggaaaggaggtcaagtaatccagaatcttcgtaacgacaccaatgctcagattcgtgttatcaaagatcatcttcctgcttgtgctttgactttgagtcatgatgagcttcttctgataattggagagcctttggttgttagagaagctctttatcaagttgcttcactgcttcatgataatccttcaagatttcaacacttactcctgtcttcttcaagttcttccatgcatcaacctggtgcaatgttaatgtctgcagcactgacgagctctcacagaaactacgctgtgcgtagagatatagcagatgcaagagaattttgtgtttgcttcatctgtccagctgaaaacgttggaggtgtgattggaaaaggcggtggtttcattaatcagatcaggcaagaaactggtgctactattagagtcaatacctcagaaactgatgatgatgattgcatcattttcatatcatcaaaagagttctacgaagatcaatctccagcggtgaatgcagcaatacgcttacaacagcgatgcagtgagaaagttggtaaagatgcaaatgatttagcaatctctacgcgtttacttgtatcgagttcccaaatcgggtgtctcattggaaaaggtggagcagttatatctgagatgaggagtgtaacaagagctaatattcgtattcttcaaaaagaagatgtaccaaaaattgctcgtgaagatgaagagatggttcagattacaggaagtcctgatgccgctatgaaagctctcacgcaagtaatcttgcgattaagagctaactctttcgacatggatcatggacttgtcttgctaccaacatcttttccatatatccctcaagtgactgaaagttcgagcaaatccaaatacgcaaaacgcgatgaccacagtaaactgaattcgaattctaagagaagaaaccatgtttcttaaatcaagaaaaccaatcttagagaggaagattgagagtgttcagaacttcaatgttgatgcaatttttatacaatattatgttacttgtaggaaaaaaaagttgtctatgcaattcacataagaaatgtaaacaagagatggggggtttcatctttgccttttttccttttacg

SEQ ID NO: 112 - protein, 479 aa, Arabidopsis thaliana
  G1219
MASTLRNIHDKRSNSQSESTGNGGSKIRNLHDETDQNVIASEDTVYRYLCPVKKTGSIIGKGGEIAKQIRSETKSNMRINEALPGCEERVVTMYSTNEELNHFGDDGELVCPALDALFKVHDMVVADADQDDGTDDDNDLGEKQTVTVRMLVPSDQIGCVIGKGGQVIQNLRNDTNAQIRVIKDHLPACALTLSHDELLLIIGEPLVVREALYQVASLLHDNPSRFQHLLLSSSSSSMHQPGAMLMSAALTSSHRNYAVRRDIADAREFCVCFICPAENVGGVIGKGGGFINQIRQETGATIRVNTSETDDDDCIIFISSKEFYEDQSPAVNAAIRLQQRCSEKVGKDANDLAISTRLLVSSSQIGCLIGKGGAVISEMRSVTRANIRILQKEDVPKIAREDEEMVQITGSPDAAMKALTQVILRLRANSFDMDHGLVLLPTSFPYIPQVTESSSKSKYAKRDDHSKLNSNSKRRNHVS

SEQ ID NO: 113 - DNA, 1228 bp, Arabidopsis thaliana
  CDS (97)..(1170): G1228
ggggtttcctcttctgcctctttggtgattcttagcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatcttttttt

SEQ ID NO: 114 - protein, 358 aa, Arabidopsis thaliana
  G1228
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 115 - DNA, 1349 bp, Arabidopsis thaliana
  CDS (287)..(1042): G1232
gcatctctttcgcaaaaggcattgattttgctatagcgaatagtgataggggtttttttttctaagcgcagctctctcttctcaatttccccaaatgaaataaattcctccgaaagtttatagatttcactctcccccgaactatacaaaattccctcaaaaggaaaaactaaaaagccgatcttggcttttttgtttctgagtgcatctcgatacttggaagcattctttggtgaggctgattcattctcatcttgtgaaagtctttggcttttgaagcaatactatggaaggaattcagcatcctatacctcgcactgtcgaagaggtttttagcgactttcgtggtcgtagagctggtctcatcaaggctctctctactgatgtacagaagttttaccatcagtgtgaccctgagaaggaaaacttgtgtctttatggacttccaaatgagacatgggaggttaatcttcccgttgaggaggtccctcctgagcttcctgaaccagcgttaggcatcaatttcgcaagggacggaatgcaagaaaaagactggatttctttggttgcagttcacagtgattcatggcttatctctgttgcattttactttggtgcacgtttcggatttggcaagaatgagaggaagaggctcttccagatgataaatgatctcccaaccattttcgaggttgtaactggcaatgcaaagcaatccaaggatcaatctgctaaccacaacagtagcagaagcaaatctagtggtggcaagcctcgtcattctgaatctcacactaaggcttcaaagatgtcccctccaccaagaaaagaagatgagagcggagatgaggatgaagatgacgagcaaggtgctgtttgtggtgcgtgtggcgacaactatggaggagatgagttctggatatgttgtgatgcttgcgagaaatggttccatgggaaatgcgtgaagatcacaccagcaaaggctgagcatatcaaacattacaaatgcccaagttgcactaccagcaagaaaatgaaagcctgaaagtgataataacattagagcctgtgaaagaggaaaacgttttcacagtttaagaagacagtacaagagtttagctgtgggaagaagaagaaacaaaaggcttctgattgcgtagttttaatgggattgagacagcttacagttagtaatgtctctttctcttttcttttctttttttttgctgttaatgttaaaatgttatgactaatttgccttaagtttctgaaaaaattctgtcttttaaccactctctagtctatgtcaaggggtttcttcttctcggaaaaaaaaaaaaaaaaaaaaa

SEQ ID NO: 116 - protein, 252 aa, Arabidopsis thaliana
  G1232
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 117 - DNA, 1057 bp, Arabidopsis thaliana
  CDS (87)..(824): G1233
gcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagcatacaaaactctctctttagatctcaagaaagggatttcaagaagttgagggagagagtagcaaactgtttgaataatattattattattcatattaaa

SEQ ID NO: 118 - protein, 246 aa, Arabidopsis thaliana
  G1233
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 119 - DNA, 1133 bp, Arabidopsis thaliana
  CDS (154)..(891): G1236
tcttgttccgtctgcttctctccatctccttccatatctattgttctctctctcttcatgcccgaacgcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagcatacaaaactctctctttagatctcaagaaagggatttcaagaagttgagggagagagtagcaaactgtttgaataatattattattattcatattaaaaaaaaaaaa

SEQ ID NO: 120 - protein, 246 aa, Arabidopsis thaliana; identical to SEQ ID NO: 118
  G1236

SEQ ID NO: 121 - DNA, 782 bp, Arabidopsis thaliana
  CDS (114)..(608): G1240
tctgactctagcagatctggtacccgtcgacccacgcgtccgggttcttttctttttgtttcattttcttatctcctcacactcttcgaacaaggaagaaccctaatctcaagatgaatagggagaagttgatgaagatggctaataccgtccgcactggcggaaagggtactgtcagaagaaagaagaaggctgtgcacaagaccaatacaactgatgacaagaggcttcaaagcactcttaagagaattggagttaactccattcccgctattgaagaagttaacatctttaaggatgatgttgttattcagttcatcaaccctaaggttcaagcttcaattgctgcaaacacatgggttgttagcggttctcctcagaccaaaaaattgcaagatatccttcctcagatcatcagccaacttggaccagacaacatggacaacctgaagaagctagcagaacagttccagaaacaggcttctggtgaaggtaatgccgcctcagcaaccatacaagaagaggatgatgacgatgtcccagagcttgttggagagacattcgaaactgctgctgaagagaaagcaccagctgctgctgcttcttcttagagagaaaagagcgagaccacatccaaaaaaaaaccgcactttgatttttacatatctttataatatgtttgttcgctcgatcctttttgtagtttccgaccagaatcttgttttccatctaatgacttaaggtttttatccaaaaaaaaaaagaaaaaaaaaaaaaaaaaa

SEQ ID NO: 122 - protein, 165 aa, Arabidopsis thaliana
  G1240
MNREKLMKMANTVRTGGKGTVRRKKKAVHKTNTTDDKRLQSTLKRIGVNSIPAIEEVNIFKDDVVIQFINPKVQASIAANTWVVSGSPQTKKLQDILPQIISQLGPDNMDNLKKLAEQFQKQASGEGNAASATIQEEDDDDVPELVGETFETAAEEKAPAAAASS

SEQ ID NO: 123 - DNA, 2210 bp, Arabidopsis thaliana
  CDS (108)..(1928): G1242
ctcaaggtggcatgttcaaaagcaaaacagtactacaaggctttactgcaaagggatcttgaagtggttaatggtggggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcagatgacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggaaccctcaagttgacttgcaagctcaggatcgtgcacataggattggtcaaaaaaaagaagttcaagtgttccggttctgcaccgagaatgctattgaggctaaagtcattgagagagcttacaagaagttggcacttgatgctctggttattcagcaagggagattggcagaacagaaaactgttaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtgctgacttttatgattttgacgatgacaacaaggatgagagcaaggtggattttaaaaagattgtgagtgaaaattggaatgatccaccaaaaagagagagaaagcgcaactactctgaagttgaatacttcaagcaaacgttgcgacaaggtgctccagctaaacctaaagagcctagaattccacgcatgccccaattgcatgattttcagttctttaacattcagaggctgactgagctgtatgaaaaagaagtgcgataccttatgcaagcacatcagaaaactcaaatgaaagacacaattgaggttgatgaacctgaagaagttggagatcccttaactgctgaagaagtggaagaaaaggagctattgctggaagagggtttctcaacatggagcagaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatgattacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatgatatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaagagtgcaacgccatcaaaacgaccttcgggtaggcaagcaaatgagagcccttcatctcttctgaagaaacgaaagcagctgtcaatggatgattatggaaagcgtaggaaataagaaggcttgtgttgaatccatcactaagtaatcagaaagatttatgatcacttctaggtttgattccgaatcggagaattagttagaagaagctccttagagacaaggatctaatattttgtacccgcaagcatcactgcattgtctccgacttctcttatttcttcaacgtgtattttactctattttgtttgtagaaatattcaccacattcctagtagtgcgtttttagtaaatctcaaatgaacttttgtggtcggatttgaacaaaaaaaaaaa

SEQ ID NO: 124 - protein, 607 aa, Arabidopsis thaliana
  G1242
MQLRKCCNHPYLFQGAEPGPPYTTGDHLVTNAGKMVLLDKLLPKLKDRDSRVLIFSQMTRLLDILEDYLMYRGYQYCRIDGNTGGDERDASIEAYNKPGSEKFVFLLSTRAGGLGINLATADVVILYDSDWNPQVDLQAQDRAHRIGQKKEVQVFRFCTENAIEAKVIERAYKKLALDALVIQQGRLAEQKTVNKDELLQMVRYGAEMVFSSKDSTITDEDIDRIIAKGEEATAELDAKMKKFTEDAIQFKMDDSADFYDFDDDNKDESKVDFKKIVSENWNDPPKRERKRNYSEVEYFKQTLRQGAPAKPKEPRIPRMPQLHDFQFFNIQRLTELYEKEVRYLMQAHQKTQMKDTIEVDEPEEVGDPLTAEEVEEKELLLEEGFSTWSRRDFNAFIRACEKYGRNDIKSIASEMEGKTEEEVERYAQVFQVRYKELNDYDRIIKNIERGEARISRKDEIMKAIGKKLDRYRNPWLELKIQYGQNKGKLYNEECDRFMICMVHKLGYGNWDELKAAFRTSPLFRFDWFVKSRTTQELARRCDTLIRLIEKENQEFDERERQARKEKKLSKSATPSKRPSGRQANESPSSLLKKRKQLSMDDYGKRRK

SEQ ID NO: 125 - DNA, 1396 bp, Arabidopsis thaliana
  CDS (32)..(1288): G1243
aaagagcttccaagaagttagccttgatgttatggttattcaacaagggagattggcagaacagaaaactgtcaataaggatgagttgcttcaaatggtaagatatggtgctgagatggtgttcagttctaaggatagcacaatcacagccgaggatattgatagaatcattgccaaaggagaagaggcaacagttgaacttgatgttaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgaacgatttccagttctttaacattcagagattgaccgagttgtatgaaaaggaagtacgttatctcatgcaaacacatcagaaaaatcagttgaaagacacaattgatgttgaagaaccagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggctgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatgagattatgtgtttacggatctgtcgagtctttgttgttacatatagttaagctaatgttaaaaacatagcaaatggatttcattctgctttcatgaatgtttgtcc

SEQ ID NO: 126 - protein, 419 aa, Arabidopsis thaliana
  G1243
MVIQQGRLAEQKTVNKDELLQMVRYGAEMVFSSKDSTITAEDIDRIIAKGEEATVELDVKMKKFTEDAIQFKMDDSADFYDFDDDNKDENKLDFKKIVSDNWNDPPKRERKRNYSESEYFKQTLRQGAPAKPKEPRIPRMPQLNDFQFFNIQRLTELYEKEVRYLMQTHQKNQLKDTIDVEEPEGGDPLTTEEVEEKEGLLEEGFSTWSRRDFNTFLRACEKYGRNDIKSIASEMEGKTEEEVERYAKVFKERYKELNDYDRIIKNIERGEARISRKDEIMKAIGKKLDRYRNPWLELKIQYGQNKGKLYNEECDRFMICMIHKLGYGNWAELKAAFRTSSVFRFDWFVKSRTSQELARRCDTLIRLIEKENQEFDERERQARKEKKLAKSATPSKRPLGRQASESPSSTKKRKHLSMR

SEQ ID NO: 127 - DNA, 1000 bp, Arabidopsis thaliana
  CDS (77)..(826): G1300
gtcttcttcaattattctattccctctgagagattctctctgcgtttcttagatcgagcgagcgaagcgagagatcatggaaggtggagctgctctctacaatcctcgaactgtcgaagaagttttcaaggatttcaaaggtcgtcgtactgccattgtcaaagctctcaccaccgatgttcaagagttttaccaacaatgtgaccctgagaaggagaatctttgcttgtatgggttaccgaatgaagaatgggaagtgaatttaccagctgaagaagtgcctcctgagttaccagagccagctcttggtattaactttgctagggatgggcactctgaaaaggaatggctttcgcttgttgctattcacagtgacgcttggatactgtctgtctcgttttactttggctcaaggttttctttccacaaggaagagaggaagcgtttgttcaacatgatcaatgatgttcctactatatttgaagtagtgactggaatggctaaagcaaaggacaagtcatctgctgcaaatcaaaacggaaacaaatccaagtctaactctaaagttagaacttcagagggaaaaagctcaaagaccaagcagccaaaagaggaggacgaagaaatagatgaagatgatgaggatgaccacggggaaaccctttgtggagcctgtggagacagtgatggtgctgatgaattctggatctgctgtgacctttgtgagaagtggttccatggcaagtgtgtgaagatcactccagctagagctgagcatatcaaacaatacaagtgcccttcatgcagcaacaaaagagctcgagcttaaaaatgttgtattgtagagaatagcctgtagtgacaactctcactaccctcgatctgtctttatttggctagtcttttagctcgttattggccataacagcttgggcctatttctctgtataattggtttgattttgcaactgagaaaaaaaaggaaactctttaactgaaa

SEQ ID NO: 128 - protein, 250 aa, Arabidopsis thaliana
  G1300
MEGGAALYNPRTVEEVFKDFKGRRTAIVKALTTDVQEFYQQCDPEKENLCLYGLPNEEWEVNLPAEEVPPELPEPALGINFARDGHSEKEWLSLVAIHSDAWILSVSFYFGSRFSFHKEERKRLFNMINDVPTIFEVVTGMAKAKDKSSAANQNGNKSKSNSKVRTSEGKSSKTKQPKEEDEEIDEDDEDDHGETLCGACGDSDGADEFWICCDLCEKWFHGKCVKITPARAEHIKQYKCPSCSNKRARA

SEQ ID NO: 129 - DNA, 1011 bp, Arabidopsis thaliana
  CDS (213)..(830): G1322
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 130 - protein, 206 aa, Arabidopsis thaliana
  G1322
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 131 - DNA, 969 bp, Arabidopsis thaliana
  CDS (7)..(846): G1318
aaaaatatgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctggtcggaccgataacgagatcaagaatttctggaactcaacaataaagaaaaggctaaagaagatgtccgatacctccaacttaatcaacaactcatcctcatcacccaacacagcaagcgattcctcttctaattccgcatcttctttggatattaaagacattataggaagcttcatgtccttacaagaacaaggcttcgtcaacccttccttgacccacatacaaaccaacaatccatttccaacgggaaacatgatcagccacccgtgcaatgacgattttaccccttatgtagatggtatctatggagtaaacgcaggggtacaaggggaactctacttcccacctttggaatgtgaagaaggtgattggtacaatgcaaatataaacaaccacttagacgagttgaacactaatggatccggaaacgcacctgagggtatgagaccagtggaagaattttgggaccttgaccagttgatgaacactgaggttccttcgttttacttcaacttcaaacaaagcatatgaatatttttacgtcatcttattcttttttctattgcggtttatactcaagattcttagccacacacacataaatgcaaatatatatacattgttagagagtattttgtatttcgtataatc

SEQ ID NO: 132 - protein, 280 aa, Arabidopsis thaliana
  G1318
MRKPEVAIAASTHQVKKMKKGLWSPEEDSKLMQYMLSNGQGCWSDVAKNAGLQRCGKSCRLRWINYLRPDLKRGAFSPQEEDLIIRFHSILGNRWSQIAARLPGRTDNEIKNFWNSTIKKRLKKMSDTSNLINNSSSSPNTASDSSSNSASSLDIKDIIGSFMSLQEQGFVNPSLTHIQTNNPFPTGNMISHPCNDDFTPYVDGIYGVNAGVQGELYFPPLECEEGDWYNANINNHLDELNTNGSGNAPEGMRPVEEFWDLDQLMNTEVPSFYFNFKQSI

SEQ ID NO: 133 - DNA, 1218 bp, Arabidopsis thaliana
  CDS (100)..(849): G1326
ttgttatcatttcaccttagactaatctatcttatacctctttcttcaacaattgctaattggtttgatataggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcaggtaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacggctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatcttctatcaattataactctcatttcctatatcattcaaatatatacatatccataacatgtaggtgtgtatctatacgtgtatcacatgcacttaattaagattggtgaatatacatacacatataagtttgtctatatcatcagtatattgcatgcatggtttattgtttgatacagaatcatgtaacaaatacgtatacacaaagatatgctcaaagaaagatatgctaactaacttttctaagtgtatttagacccaaaaaaaaaaaa

SEQ ID NO: 134 - protein, 250 aa, Arabidopsis thaliana
  G1326
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 135 - DNA, 1179 bp, Arabidopsis thaliana
  CDS (101)..(961): G1269
cccacgcgtccgaaacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 136 - protein, 287 aa, Arabidopsis thaliana
  G1269
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 137 - DNA, 1292 bp, Arabidopsis thaliana
  CDS (177)..(1073): G1308
  "n" bases represent variable nucleotides
ctttgattccnatcttcttctcttaattttcactttgggctttctctgtctctcctattatgagtctaaaagtctactagctgttcaatagttttgtctttctgtgtttctcttcttcaaaaccgaaagaaattcaaaaagagtctttcgctgcttgttagtggggtgaggaacaaatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctcaacaaattcttggggagggaaagaggttactgtggcgattcatggctcagattattctccatattcaaatgatcttgaagatgattcaacagactctgctcttcaacttctgcttgatttccctataagcgatgatgatatgagcttcttggaagagaacattgacagctactcacaggctcctcctattggtcttgtttccatggtttccaaattctagtcttatgagagcctaatatctaagaaaaagattcaaactttgcttccttttggtttttagtgatgataagtagggatatagtatctatgtaaatcagcattagttagttgaagtacttaatcaaccctttcttttatgatttgatcatgtttgagaaaattgcagaacattaaacaattaaccattcaaaaaaaaaaaaaaaaaaaaaaaaaaaaa

SEQ ID NO: 138 - protein, 299 aa, Arabidopsis thaliana
  G1308
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEPLPSYGLAKQAPSSPTTRHMAQWESARVEAEARLSRESMLFSPSFYSGVVKTECDHFLRIWNSEIGEAFRNLAPLDESTITSQSPCSRATSTSSALLKSSTNSWGGKEVTVAIHGSDYSPYSNDLEDDSTDSALQLLLDFPISDDDMSFLEENIDSYSQAPPIGLVSMVSKF

SEQ ID NO: 139 - DNA, 800 bp, Arabidopsis thaliana
  CDS (41)..(754): G1311
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 140 - protein, 238 aa, Arabidopsis thaliana
  G1311
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 141 - DNA, 1428 bp, Arabidopsis thaliana
  CDS (70)..(1425): G1313
aactttccggagttagggtgggagcttgatgtctaaattgttactgtcagtggtttaattagaaaagagatgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatggctaatagatgggcacgtatggctgcacatttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatccagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacagacgatttccaaaacttgcagcttctcagttccttgtgatgttgagcatcctctctatggaaaccgacattcacctgttatgattccagatagccatacccctacggatggcattgttccttattctaagcccttatatggggcagttgaagctggagctcccttcattccaatattccagaaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttga

SEQ ID NO: 142 - protein, 452 aa, Arabidopsis thaliana
  G1313
MSYTSTDSDHNESPAADDNGSDCRSRWDGHALKKGPWSSAEDDILIDYVNKHGEGNWNAVQKHTSLFRCGKSCRLRWANHLRPNLKKGAFSQEEEQLIVELHAKMANRWARMAAHLPGRTDNEIKNYWNTRIKRRQRAGLPLYPPEMHVEALEWSQEYAKSRVMGEDRRHPDFLQLGSCESNVFFDTLNFTDMVPGTFDLADMTAYKNMGNCASSPRYENFMTPTIPSSKRLWESELLYPGCSSTIKQEFSSPEQFRNTSPQTISKTCSFSVPCDVEHPLYGNRHSPVMIPDSHTPTDGIVPYSKPLYGAVEAGAPFIPIFQKTTFDQWKKSSSPPHSDLLDPFDTYIQSPPPPTGGEESDLYSNFDTGLLDMLLLEAKIRNNSTKNNLYRSCASTIPSADLGQVTVSQTKSEEFDNSLKSFLVHSEMSTQNADETPPSELLFTLPSLEIVC

SEQ ID NO: 143 - DNA, 1337 bp, Arabidopsis thaliana
  CDS (114)..(1100): G1314
  "n" bases represent variable nucleotides
ccncncnnntnggnctnaacngccggcccggccaggtaaaaaagcaagtaagagataacaatttctctctttttcttttctcttcttcaaacttcaattcactaacgagagaaatgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgactcatcatcatcagccatggcttctccttatctaaaccctatttctcaggatgtgaaaagaccaacctcaccaacaacaatcccatcttcttcttacaatccgtatgccgaaaaccctaatcaatacccaacaaaatccctcatctctagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgccaatgggataagatcagagattatgatgaagcaagaagagataatgatgatgatgatgatagaccaccacattgaccagaagacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctagttcttctagactctcttgtcttcttatataaatatatcttggactgactgttagtaatatcaaagatttgatggggtatgggaggagagagaatgagatagagagcgactatgatcagttttatgggattttgtattttttttttgtttatttatctctctttattggatttctagttaagaagagacaatgttaatgggactatgggagatttgaaaaaaaaaagaaaaaaaa

SEQ ID NO: 144 - protein, 329 aa, Arabidopsis thaliana
  G1314
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDANGIRSEIMMKQEEIMMMMMIDHHIDQKTKGYNGEFTQGYYNYYNGHGDLKQMISGTGTNSNINMGGSGSSSSSISNLAENKSSGSLLLEYKCLPYFYS

SEQ ID NO: 145 - DNA, 1011 bp, Arabidopsis thaliana
  CDS (86)..(976): G1315
tttttcttttcccttcttctctttcaaaaaacaaaacaaagatatctcaaccggaacacttagaccaagagagacagatagagagatgggtagggctccatgttgtgacaaggcaaatgtgaagagaggtccatggtctcctgaagaagacgcaaagcttaaagattacatcgagaaacaaggaactggtggcaattggattgctctccctcacaaagctggtttaaggagatgtgcgaagagttgcagactgagatggttaaattatttgagaccaaacataagacatggagatttcactgaagaagaagacaatattatctacagcctctttgcctccattggaagcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactgatctcgagtaccaactttgatttaatctccaaa

SEQ ID NO: 146 - protein, 297 aa, Arabidopsis thaliana
  G1315
MGRAPCCDKANVKRGPWSPEEDAKLKDYIEKQGTGGNWIALPHKAGLRRCAKSCRLRWLNYLRPNIRHGDFTEEEDNIIYSLFASIGSRWSVIAAHLQGRTDNDIKNYWNTKLKKKLIATMAPPPHHHLAIATSSSSASPSSSSHYNMINSLLPYNPSTNQLLTPHQGIMMTMMGQQQQLFYQEDMGNLVNSPNRNNLIMSHQEDNQEQSTNKGIMLLSDVRSGSSTTSTVTRVKMEHRDHDDHHHHEEDERSMTSVVMEDYGMEEIKQLISSSCTSSNNSLWFDENKTEDKFMLYY

SEQ ID NO: 147 - DNA, 1146 bp, Arabidopsis thaliana
  CDS (139)..(984): G1317
gcgcccgcccgggcaggtctaaaatccaactcctctttttgaaaattaagaaactccacttggctcttcgattttttctatctaaataacagaaccaaatcattatcgaaatttaaagttgtgcgaaacaaaacaaagatgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagacttgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaattttcaacatttgcatacacatgtcttgctttcacacatatgattctttgttgcattctttcttttgtttgatgtataaatttcttgtttttattctctcaaaagatattaagttattagtttataaaattttcatgaaaaaaaaaaaaaaaaaaaaaa

SEQ ID NO: 148 - protein, 282 aa, Arabidopsis thaliana
  G1317
MGRSPCCDKNGVKKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVRSGIDPVTHSPRLDLLDLSSLLSALFNQPNFSAVATHASSLLNPDVLRLASLLLPLQNPNPVYPSNLDQNLQTPNTSSESSQPQAETSTVPTNYETSSLEPMNARLDDVGLADVLPPLSESFDLDSLMSTPMSSPRQNSIEAETNSSTFFDFGIPEDFILDDFMF

SEQ ID NO: 149 - DNA, 1142 bp, Arabidopsis thaliana
  CDS (63)..(1004): G1319
catcaatacattaccaagaaaccagagtttttcttcattgttcttttccacagcattgcaacatgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgtgaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctttagtttctttttcttatcagatttagacatattgatacgtgtaatgaatggatcaaatgttctatttggccatacgttaaaaaaataaaaaagcacaatcctttcctgaaaaaaaaaaaaaaaaaaaaaaaaaaaaaa

SEQ ID NO: 150 - protein, 314 aa, Arabidopsis thaliana
  G1319
MKRHSCCYKQKLRKGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKKKLMKKGIDPITHKPLSEVGKETNRSDNNNSTSFSSETNQDLFVKKTSDFAEYSAFQKEESNSVSLRNSLSSMIPTQFNIDDGSVSNAGFDTQVCVKPSIILLPPPNNTSSTVSGQDHVNVSEPNCESNSGTTSHLNNPGMEEMKWSEEYLNESLFSTQVYVKSETDFNSNIAFPWSQSQACDVFPKDLQRMAFSFGGQTL

SEQ ID NO: 151 - DNA, 1137 bp, Arabidopsis thaliana
  CDS (54)..(911): G1324
cgaaaacaccacaaaccaaatatcattaagtaattaggaaacttaaactaagtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgttaaatttgtatcttctttgttgcgagtacttactaagtcattggataaatatttataatgatagtttcttgtacaaaaaaaaaaa

SEQ ID NO: 152 - protein, 286 aa, Arabidopsis thaliana
  G1324
MENSMKKKKSFKESEDEELRRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTRVQKQARQLNIESNSDKFFDAVRSFWVPRLIEKMEQNSSTTTTYCCPQNNNNNSLLLPSQSHDSLSMQKDIDYSGFSNIDGSSSTSTCMSHLTTVPHFMDQSNTNIIDGSMCFHEGNVQEFGGYVPGMEDYMVNSDISMECHVADGYSAYEDVTQDPMWNVDDIWQFRE

SEQ ID NO: 153 - DNA, 1063 bp, Arabidopsis thaliana
  CDS (161)..(1060): G1325
tgttactttgatctctttctccatccttgtctctgtcgattctatgagatatcttctctcgagctttttcccgcgttatctctctcccactcctggttggagcttgatgtctaaattgttattgaactgctggagtctgtcttgctttaagtagaaagagatgagttacacgacggcgactgctgatagtgatgatggtatgcactccagcatccataatgaatcaccagctcctgatagtattagcaatggctgcagaagtagagggaaaagaagtgtcctgaagaaaggaccatggacttcaactgaagacgggattttaattgattatgtaaagaagcacggcgagggtaactggaatgctgtgcagaaacacactagcctggcccgttgtggtaaaagctgtcgtctgagatgggctaatcatctgaggccaaacttgaagaaaggagcatttagccaagaagaagaacagctcattgttgaaatgcacgccaagatgggaaataaatgggcacagatggctgaacatttacctggtcgaacagataatgagataaagaattattggaacactcgtatcaagaggagacaacgagcaggcttaccactttaccctcctgaaatctatgttgatgaccttcattggagcgaagagtatacaaagagtaatatcataagagtagatagaagaagaagacatcaagatttcttgcagttggggaattctaaagataatgtcttatttgacgatctaaattttgctgctagcttgttacctgccgcttctgacctatcagatttggttgcatgcaacatgctaggaactggcgcaagttcttcccggtatgagagctacatgccaccaatattgccttccccaaagcaaatctgggaatctggatctcggtttcccatgtgcagcagtaacataaagcatgaattccaatcgccggaacactttcagaatacggctgtacagaaagaatcccagatcttgcagtatctcgccttgttgatgttgatcatcatccttatgaaaaccaacattcgtctcatatga

SEQ ID NO: 154 - protein, 300 aa, Arabidopsis thaliana
  G1325
MSYTTATADSDDGMHSSIHNESPAPDSISNGCRSRGKRSVLKKGPWTSTEDGILIDYVKKHGEGNWNAVQKHTSLARCGKSCRLRWANHLRPNLKKGAFSQEEEQLIVEMHAKMGNKWAQMAEHLPGRTDNEIKNYWNTRIKRRQRAGLPLYPPEIYVDDLHWSEEYTKSNIIRVDRRRRHQDFLQLGNSKDNVLFDDLNFAASLLPAASDLSDLVACNMLGTGASSSRYESYMPPILPSPKQIWESGSRFPMCSSNIKHEFQSPEHFQNTAVQKESQILQYLALLMLIIILMKTNIRLI

SEQ ID NO: 155 - DNA, 1042 bp, Arabidopsis thaliana
  CDS (168)..(881): G1327
attcaaaaacatggccatcaaaactggagatctcttcccaagctggtggttaggatttattcacatgcatgtttcggtaatactataaagttttaaataactaagagaaataatgattgatatatatacataggattgttgagatgtgggaaaagttgccgactaagatggataaactatctgagccggacgtgaagcgaggcaactttagcaaaaaggaggaagatgctatcattcactaccatcaaacccttggaaacaagtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtctcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatgaatgtcaataatatatgcatgaccagtgttgtatccacttttgaatgttgagtaaattactattttacatggattgcccatgcattgagaagatgctatgttttatgagagctctatgatattggttcgtttttcggctaaaaaaaaaaaaaaaaaaaa

SEQ ID NO: 156 - protein, 238 aa, Arabidopsis thaliana
  G1327
MDKLSEPDVKRGNFSKKEEDAIIHYHQTLGNKWSKIASFLPGRTDNEIKNVWNTHLKKRLTPSSSSSSLSSTHDQSTKADHDKNCDGAQEEIHSGLNESQNSATSSHHQGECMHTKPELHEVNGLNEIQFLLDHDDFDDITSESLQDNDILFPLDSLLHNHQTHISTQEMTREVTKSQSFDHPQPDIPCGFEDTNEESDLRRQLVESTTPNNEYDEWFNFIDNQTYFDDFNFVGEVCL

SEQ ID NO: 157 - DNA, 1432 bp, Arabidopsis thaliana
  CDS (259)..(1152): G1362
aggtagaatctctattcgagtccccaagattctctttatatccctagtttagttgtatggttgggttttgattggaatatcaaggggtagtttttagctaggttcacttgatacttggaagatctgagttctttgggattctgttaagtttgtggagatctaaaagacacgaaatttgtagaaatctggttgatatcccagacttttagagggattagggtagattctatagaatttgaggcgggtttgattggaattatgacggtggaggaagttagtgatggttctgtgtggagtagggaggatgatattgcctttgagagacctctagccaataataccgatgaatcagaggaacggtgggagaagattgctgcagacgttccaggcaaaagtgttgaacagattaaagaacattacgagcttttagttgaagatgttactaggattgaatcaggatgtgtgcctcttcctgcctatgggtctcctgaaggatcgaatggccatgctggtgatgaaggagcaagtagtaagaaaggaggtaacagtcatgcgggagagtctaaccaagcaggtaaatcaaagtccgatcaagaacgacgaaagggtatcgcgtggacagaagatgagcacaggttatttcttcttggtttggataagtacgggaaaggtgattggcgtagcatttctcgcaactttgtagtaacaagaacaccgacccaagttgcgagccatgctcaaaagtatttcattcgtctaaattcaatgaacaaagacagaaggcgatcaagcattcacgacatcactagtgttggcaacgcagatgtctcaaccgccacaaggccaatcactggtcagaacaacagcaataacaacaacaacaacaacaacaacaacagttctcctgctgttgctggaggaggaaacaaatcagccaagcaagccgtctctcaagcaccacctggacctcctatgtatggaacacccgccataggtcagccagcagttggaacaccagtgaacctcccagctccacctcacatggcttatggagttcatgcggctccagtccctggctcagtggttcctggtgcagcaatgaacattggtcaaatgccgtacaccatgccgcgtacaccaacggctcataggtaactcgaaagcacctttgctgtcatagtgcactttgtttttaggtgtaagaaagaagatgtgtaaaggatttagtgaatattcaagcttgttccttgagtgagttttttttattacttagtttgtggggattttgtatgaggtccgaataagatatgaagatgacatgattagtttccagactcgagaagcaaaaatactcctgtttgtatgtgaacacaataaagcctctgttatgagacttacaacaaagcaacattgtatatcttgttctcacaaa

SEQ ID NO: 158 - protein, 298 aa, Arabidopsis thaliana
  G1362
MTVEEVSDGSVWSREDDIAFERPLANNTDESEERWEKIAADVPGKSVEQIKEHYELLVEDVTRIESGCVPLPAYGSPEGSNGHAGDEGASSKKGGNSHAGESNQAGKSKSDQERRKGIAWTEDEHRLFLLGLDKYGKGDWRSISRNFVVTRTPTQVASHAQKYFIRLNSMNKDRRRSSIHDITSVGNADVSTATRPITGQNNSNNNNNNNNNNSSPAVAGGGNKSAKQAVSQAPPGPPMYGTPAIGQPAVGTPVNLPAPPHMAYGVHAAPVPGSVVPGAAMNIGQMPYTMPRTPTAHR

SEQ ID NO: 159 - DNA, 1158 bp, Arabidopsis thaliana
  CDS (193)..(891): G665
ccaacttggacaacatcatttaaattataaaaccctccaataaataaaacttggtttatccaatcatcttatttctctgtgctctccaccattttacataaaccccaaaatctctcttcatcatcatcattcatcaacatcatctctctttctctatctcgctgtccctccttctctttctcattcattgcaatgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtgaatctatataacacgttatgatcagtttcattagaataattcaaatgtttacatatataatatcttatcgatcctatctaatttgattttgatttaacgttagttactttgataatttcgtcgatattgtttttttggttttttcattgtgagattttttgtcttggaagttggatccatacatatttctgtaaaactttatatttaaggtatatatatctagcgctcataaaagtttcaatattccaaaaaaaaaaaaaaaaaa

SEQ ID NO: 160 - protein, 233 aa, Arabidopsis thaliana
  G665
MGRRCSHCGNVGHNSRTCSSYQTRVVRLFGVHLDTTSSSPPPPPPPSILAAAIKKSFSMDCLPACSSSSSSFAGYLSDGLAHKTPDRKKGVPWTAEEHRTFLIGLEKLGKGDWRGISRNFVVTKSPTQVASHAQKYFLRQTTTLHHKRRRTSLFDMVSAGNVEENSTTKRICNDHIGSSSKVVWKQGLLNPRLGYPDPKVSVSGSGNSGGLDLELKLASIQSPESNIRPISVT

SEQ ID NO: 161 - DNA, 228 bp, Arabidopsis thaliana
  CDS (1)..(225): G682
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 162 - protein, 75 aa, Arabidopsis thaliana
  G682
MDNHRRTKQPKTNSIVTSSSEEVSSLEWEVVNMSQEEEDLVSRMHKLVGDRWELIAGRIPGRTAGEIERFWVMKN

SEQ ID NO: 163 - DNA, 1027 bp, Arabidopsis thaliana
  CDS (101)..(928): G998
gaaaacataaacatagaagagcaaattaagcaacagtcttacacagacagaagttgtagaattgatttgtgagtgaaaaactatttaagactgaacaagtatgcttgattggggagttcaaggtcatcatcaaaagcatgatcatgatatttatcaacaacaacatcaacaacaaggatgtaggaagggaccatggacacttgaagaagacaagcttctcgcagagtatgttacttcgcatggtgaaggaagatggagcactgtagctaagtgtgcagggttgaatagaagtggtaaaagctgtagactaaggtgggtgaactacttgaggccagggcttaagagaggacaaatcactcctcaagaagaaggaatcatccttgaacttcattccctttggggtaacaagtggtctacaatcgcaagatatttaccaggacgaaccgataatgaaataaaaaactactggagaacacattacaagaaaaaccaaaaatcttcttcgaagcaagacaaagtaaaaaaatctctatcccggaaacaacaacaagtggatcttaaaccacaaccacaagcacaatctgagaatcatcagtctcagctagtgtcccaagatcacatgaatatcgacaacgatcataacatagcttcatccttgtattacccgacaagtgtcttcgatgacaaattatatatgcctcaaagtgtagcaacaacctcatccgaccactctatgatcgatgaaggtcacttgtggggcagcttgtggaatctagacgaggatgatccgcatagctttggtggtggctcaggacagggaacagctgcggatattgatgagaagtttccagacagcggaattgaggccccgtcgtgtggctcaggggattatagttatactggagtttacatgggaggctatattttttgattagtatgctcgaagatatcaagaagttgtgtcttcgtaggttgagaaaaaaattaaaacacaacattgtgaatttataactttagtagtgatcta

SEQ ID NO: 164 - protein, 276 aa, Arabidopsis thaliana
  G998
MLDWGVQGHHQKHDHDIYQQQHQQQGCRKGPWTLEEDKLLAEYVTSHGEGRWSTVAKCAGLNRSGKSCRLRWVNYLRPGLKRGQITPQEEGIILELHSLWGNKWSTIARYLPGRTDNEIKNYWRTHYKKNQKSSSKQDKVKKSLSRKQQQVDLKPQPQAQSENHQSQLVSQDHMNIDNDHNIASSLYYPTSVFDDKLYMPQSVATTSSDHSMIDEGHLWGSLWNLDEDDPHSFGGGSGQGTAADIDEKFPDSGIEAPSCGSGDYSYTGVYMGGYIF

SEQ ID NO: 165 - DNA, 1212 bp, Arabidopsis thaliana
  CDS (8)..(958): G759
aaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgaaaaaaaaaaaaaaaaaaa

SEQ ID NO: 166 - protein, 317 aa, Arabidopsis thaliana
  G759
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 167 - DNA, 2001 bp, Arabidopsis thaliana
  CDS (175)..(1875): G760
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 168 - protein, 567 aa, Arabidopsis thaliana
  G760
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 169 - DNA, 1198 bp, Arabidopsis thaliana
  CDS (96)..(1049): G764
atcgaattcgcggccgctcgatatctttacaaccattaaacaaaaaatttggccactacaagttgaaaaagttttgattatatctaatcgctgaaatggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaattcgctatcgataatctctctaaaaccgctaagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaaaaaaaa

SEQ ID NO: 170 - protein, 318 aa, Arabidopsis thaliana
  G764
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 171 - DNA, 1479 bp, Arabidopsis thaliana
  CDS (192)..(959): G765
tttaactgcatagttcttcctcaaattgctcatacctttgcttctctttctttctttattcaacctcttatttcttcttcagcaccaacgtgtatctgcagtaaacacatatccatcgatcgatctcctcaaaaagttattgttttcttgaaggatttttcttgttcttgatcaagcatacatatatatagatggtggaagaaggcggcgtagttgtgaatcaaggaggagatcaggaggtggtggatttgcctccggggtttcggtttcaccctactgatgaagagataataactcactacctcaaagagaaggtcttcaacatccgatttaccgcggcagcgattggtcaagccgacctcaacaagaacgagccatgggatctaccaaagattgcaaagatgggggagaaggagttttactttttctgccagagggatcggaagtatccgaccgggatgaggacgaaccgtgcgaccgtgtctggttattggaaggcgaccgggaaggacaaggagatctttagaggcaaaggttgtcttgttgggatgaagaaaacacttgttttctatacaggaagagctcctaaaggtgaaaagaccaattgggttatgcatgaatatcgtcttgatggaaaatattcttatcataacctccccaaaaccgcaagggatgaatgggtggtgtgtagggtttttcacaagaacgctcctagtactacaatcactactacaaaacaactctcaaggattgattctcttgataacattgatcatctcttagacttctcatctctccctcctctcatagatccgggtttcttgggtcaacccgcccaagcttctccggtgcccgtcaacaacacgatctcaaacctgtctccaccatcctacaaccgcaccagtcgacaacacttaccttcctacccaagctctcaatttcccttaccactcggtccctaattccggatctgatttcggctacggggcaggttcaggcaataataacaaaggtatgatcaagttggagcattctcttgtgagtgtgtctcaagaaaccggtttgagttccgatgtgaacacaaccgcaacgccagagatatcttcttatccaatgatgatgaatccggcaatgatggatggtagcaagtcagcgtgtgatggtcttgatgacttgatcttctgggaagatttatatactagctaaatttgggaaaaggttatttgttaattgtgattgaagagtggcatattgattactcgtctagtgtttttaatcgtgtaattagttcgtatataatatacatgtacataagatcattaggtttattaggcattggactttagttcggtgattgcttacctagtttttagcttgagaaaaaaggctgtcattggggttatgtttctttgtgattaacttgtacatatatacatttaaattaaacgtatggtttaaatcgtttaaaaaaaaaaaaaa

SEQ ID NO: 172 - protein, 256 aa, Arabidopsis thaliana
  G765
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPAQASPVPVNNTISNLSPPSYNRTSRQHLPSYPSSQFPLPLGP

SEQ ID NO: 173 - DNA, 1624 bp, Arabidopsis thaliana
  CDS (42)..(1421): G1426
gcaccagcggcaccaggaatcagaatcttcatgtattatcaatggattcgttaccagttggattaagattccgtccaacagacgaggagctaatccgttactatctccgtaggaaaatcaacggtcacgatgacgacgtcaaagctatccgtgagatcgatatttgcaaatgggaaccttgggatttacctgatttttctgtgatcaaaactaaagactcagagtggctctacttctgtccattggatcggaagtatccgagtggaagtagacagaaccgggcaacagttgcagggtactggaaagccacaggaaaagaccggaagataaaatccggtaagactaacattattggtgtgaagagaactctagttttccacgcgggtagagctcctagggggacacgaaccaattggattattcatgagtatcgtgccacggaggatgatcttagtggtaccaatcctggccagagtccgtttgttatatgcaaattgttcaagaaagaagaactggttttaggggaagaagattcgaagtcagatgaagttgaagaacctgctgtctcgtctccaactgtcgaagtgactaagtcagaagtatctgaggtaattaaaacagaagacgtgaagcgtcatgacatagcagaatcttctcttgtaatctctggagattctcatagtgatgcttgtgatgaggctacaaccgcagagcttgtagattttaaatggtatccggaattggagtccttagatttcacgctgttctctccattacactctcaagtccaatctgagcttggatcctcttacaacacattccagcctggctcgagtaatttttcagggaacaacaacaacagcttccaaatccagactcagtatggtacaaatgaagtagatacgtatatatctgattttcttgattcgattctcaagagcccagacgaggatccagagaagcacaagtatgttttgcaaagtggttttgatgttgtagcaccagatcagattgcgcaagtgtgtcaacagggctcagcagttgacatgagcaatgatgtttcagtgacgggtatccagattaagagtcgccaggcacaaccctcaggttataccaatgactatatagcgcagggaaatggtccaagaaggctgcgtctgcaaagtaactttaatggcattaacacgaagaatcctgagcttcaagctataaagagagaggctgaggacacggttggagaaagtataaagaaaaggtgtggaaagctaatgagatcaaagaacgtgaccggttttgtgtttaaaaagattacgtcggtgaaatgttcatatggaggactctttagggcggcagtagttgcagttgtgttcttgatgtcagtctgcagtctaaccgtcgacttcagagcatctgcagtgtcctgaaaactgaaactttttgtaaatatagtgcttgaaccggcccgtgtttttgcttctgttattggtttcaggctttcgccagtttataagatatatttgtttgtagtttttacatgtagttaggctgcttatgtaaacgttatgatgacagagaggtcaagactctatttacttctttgactaaaaaaaaaaaaaaaaaaaaa

SEQ ID NO: 174 - protein, 460 aa, Arabidopsis thaliana
  G1426
MDSLPVGLRFRPTDEELIRYYLRRKINGHDDDVKAIREIDICKWEPWDLPDFSVIKTKDSEWLYFCPLDRKYPSGSRQNRATVAGYWKATGKDRKIKSGKTNIIGVKRTLVFHAGRAPRGTRTNWIIHEYRATEDDLSGTNPGQSPFVICKLFKKEELVLGEEDSKSDEVEEPAVSSPTVEVTKSEVSEVIKTEDVKRHDIAESSLVISGDSHSDACDEATTAELVDFKWYPELESLDFTLFSPLHSQVQSELGSSYNTFQPGSSNFSGNNNNSFQIQTQYGTNEVDTYISDFLDSILKSPDEDPEKHKYVLQSGFDVVAPDQIAQVCQQGSAVDMSNDVSVTGIQIKSRQAQPSGYTNDYIAQGNGPRRLRLQSNFNGINTKNPELQAIKREAEDTVGESIKKRCGKLMRSKNVTGFVFKKITSVKCSYGGLFRAAVVAVVFLMSVCSLTVDFRASAVS

SEQ ID NO: 175 - DNA, 1164 bp, Arabidopsis thaliana
  CDS (43)..(1002): G1425
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 176 - protein, 320 aa, Arabidopsis thaliana
  G1425
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 177 - DNA, 1260 bp, Arabidopsis thaliana
  CDS (115)..(1005): G1412
cccacgcgtccgcccacgcgtccgaaacaaaaacatataatttgggtttttagagttcgaaacttgaaatctttttttttttggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccccaaaggaaaaaggctcgactggggactagtttgatccaacttgacggcccccaaatgtgtaatgtttctcaacggagagaaaaataaatggttaccaatatttttccaaaaaaaaaaaaaaaaa

SEQ ID NO: 178 - protein, 297 aa, Arabidopsis thaliana
  G1412
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 179 - DNA, 1311 bp, Arabidopsis thaliana
  CDS (1)..(1308): G746
atgggtgaggagttagctgacacaatgaacctggatttgaatcttgggcctggtcctgagtctgatctccaacctgcaccaaacgagactgtgaatttggctgattggactaatgacccgcctgagagatcttctgaagctgtgacaaggatcaggactcggcataggacacggttcagacagcttaatctcccgatcccggttctatctgaaacccataccatggctatagagctcaaccagttgatgggaaattctgtaaatagagctgctatgcagactggtgagggtagtgaaagaggcaatgaggatttgaaaatgtgtgagaatggcgatggagcccttggggacggtgtattggataagaaagcggatgtcgagaaaagcagtggcagcgacggtaactttttcgattgtaatatatgtttggatttgtcgaaggagccggttctcacctgttgtggtcatctttactgttggccttgtctgtaccaatggttacaaatttcggatgcaaaggaatgtcctgtttgtaaaggagaggtgacctccaaaaccgtgacaccgatctatggacgtggaaaccacaagagagaaattgaagagagtttagatactaaggtccccatgagaccacacgcgagacgcattgagagcttgaggaatacaattcaaaggtcgccttttacaataccaatggaagaaatgattagacgtatacagaataggtttgacagggattcaaccccagtccctgattttagtaaccgagaggcatcagaaagagtcaacgatcgagccaattcgatccttaaccggttgatgacatctaggggagttagatcagagcagaaccaggctagtgctgcagcagcagccattgtcgcagcatcagaggatattgatctaaatccaaacattgctcctgatcttgaaggagaaagcaacacgagattccatcctctcttgatcaggagacagttacagtcgcaccgagttgcaaggatctcgactttcacttctgcgttgagttcagctgagaggcttgtggatgcgtattttaggactcatccgttggggaggaaccaccaagagcaaaaccatcatgctcctgttgtggttgatgatagagactcattctcaagcattgcagctgttataaactctgagagtcaagtggatactgcagttgagatcgattctatggctctttcgacatcgtcctcgaggagaaggaatgagaatggttcgagggtttctgatgtagacagtgcagattctcgtccgcctaggagaaggagatttacttga

SEQ ID NO: 180 - protein, 436 aa, Arabidopsis thaliana
  G746
MGEELADTMNLDLNLGPGPESDLQPAPNETVNLADWTNDPPERSSEAVTRIRTRHRTRFRQLNLPIPVLSETHTMAIELNQLMGNSVNRAAMQTGEGSERGNEDLKMCENGDGALGDGVLDKKADVEKSSGSDGNFFDCNICLDLSKEPVLTCCGHLYCWPCLYQWLQISDAKECPVCKGEVTSKTVTPIYGRGNHKREIEESLDTKVPMRPHARRIESLRNTIQRSPFTIPMEEMIRRIQNRFDRDSTPVPDFSNREASERVNDRANSILNRLMTSRGVRSEQNQASAAAAAIVAASEDIDLNPNIAPDLEGESNTRFHPLLIRRQLQSHRVARISTFTSALSSAERLVDAYFRTHPLGRNHQEQNHHAPVVVDDRDSFSSIAAVINSESQVDTAVEIDSMALSTSSSRRRNENGSRVSDVDSADSRPPRRRRFT

SEQ ID NO: 181 - DNA, 1699 bp, Arabidopsis thaliana
  CDS (100)..(1590): G752
ccggcaagaacagaacgctcttctatttttctccatcttccaatttccaggaacaagattggacgaaagctaaaggtattgcatccatttaaaaagttcatggataggtggtccagtaaaagagccatggaggcgagacctgactctaagaagaagggtggtgttgtttttagagatagatttaacagcaatagttgcaaggttcctatttgtagtgatgagaaaaaatcaatgaactttactaggtttgttggctcttcagataagaaagagaaatcagtgttgtctacataccgctcttcgccaaacgggaaggaagtaattggaacttcctctaagatttgtatctctagctcctcttctgtgaaaagtggtgagaagcaaccgttttctcagatagccattgattcatcagagagcagcagaggtagtgaagacgaggtagagtcagaaatcttgcaagttcctcttggaagagataaaagaagaatgaacaataaacttatttatggaaaagttataacacctgaagcggaatgctcaaagttgccatcaagctcaagaatcaagagaggttttaggcagagatttgggttgagcaagcaagagtttcatcctggtccatctggccagtcaacatctgctaaccggggatgcagcccgttgttgtcaggtgtcattccaagtggttttggattggacaaaagattaagtcggaaggcagatacaatcagtaagacaaaagtttacggagaaagcagttctagctcctcagctagggggaagaatgtaacagaacctccaccagttgaagtgagacgtcgtagttttaatccgagaggttctgtttctgatagtagacgggctagacactgcattttggatgatgacaacgatgttgcttcagttgggagtcagagattggcaaatagaaataatagtcgcattagagggagtggtagagacggtttatcctctgtcacggcagcagagatgtctcagactgaaacatcaaacaatctcaattctcctgtctctttggagctgttctctggttttccagaatttggcctctctggttccttattgagtcatgacagttttcgcagttataatttagatgggatctccgagattctgccagaacttgataggatcgaacaagatatcgaacttaattatgaggatctgcttatcatggaaacaggtttacttctcggtggactaagcttccatgaccaacaccgagacatgaggctagacatcgataacatgtcatatgaggaactattagctctagaagagaggattggtacagtaagcactgctttgacagaagaagcaatatcaaagtgcttgaaaacaagtatctatcagatgaaacctttgagttatgggtctatcaccaaaagtcctagtgataacaaggaagatgccaaatgcagcatctgccaggaagaatatacgattggagatgaagttgggaggctacactgtgagcacacataccatgtgaagtgtgtgcaagagtggttgcggataaagagttggtgcccaatctgcaaagccacagccgaaacctcctctaaataaccgtcttcttcttcttcctcgttcgttgtattagttctttcatctaaagcctgtgaacaacaatggaacctgcgtaaaaaaggcctcaccatttcctttgtgtaaa

SEQ ID NO: 182 - protein, 497 aa, Arabidopsis thaliana
  G752
MDRWSSKRAMEARPDSKKKGGVVFRDRFNSNSCKVPICSDEKKSMNFTRFVGSSDKKEKSVLSTYRSSPNGKEVIGTSSKICISSSSSVKSGEKQPFSQIAIDSSESSRGSEDEVESEILQVPLGRDKRRMNNKLIYGKVITPEAECSKLPSSSRIKRGFRQRFGLSKQEFHPGPSGQSTSANRGCSPLLSGVIPSGFGLDKRLSRKADTISKTKVYGESSSSSSARGKNVTEPPPVEVRRRSFNPRGSVSDSRRARHCILDDDNDVASVGSQRLANRNNSRIRGSGRDGLSSVTAAEMSQTETSNNLNSPVSLELFSGFPEFGLSGSLLSHDSFRSYNLDGISEILPELDRIEQDIELNYEDLLIMETGLLLGGLSFHDQHRDMRLDIDNMSYEELLALEERIGTVSTALTEEAISKCLKTSIYQMKPLSYGSITKSPSDNKEDAKCSICQEEYTIGDEVGRLHCEHTYHVKCVQEWLRIKSWCPICKATAETSSK

SEQ ID NO: 183 - DNA, 435 bp, Arabidopsis thaliana
  CDS (51)..(269): G1395
attttttccggcgagcggtgctgataacctcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactcattagttttttgatgttttcgatgtagcatgcatgatattttcttgagttgacaatctataagctttactgagataaaaaaaaa

SEQ ID NO: 184 - protein, 73 aa, Arabidopsis thaliana
  G1395
MAAEFDGKIESKGLNPGLIVLLVIGGLLLTFLVGNFILYTYAQKNLPPRKKKPVSKKKMKKEKMKQGVQVPGE

SEQ ID NO: 185 - DNA, 1665 bp, Arabidopsis thaliana
  CDS (223)..(1437): G477
tcttttgcttgcttcctatacacagttcttctctgttcctctaacgggtttgaatcttttcgtcaatttctatctgggttttgtgttaatcgaaggaataagtgaatcgtcgtcttgggttttctctatttagaagaaagcttcctcctttagggtttctgcatcagttattgaattgctagttgtcgttgaagaaagcagaaattgattatagtgttgctgatggattcttggagctacgggagaagcgttttcatgtcaaatgaaactcttttaccttgtgatacttttgctaagaatagaagatttgaacagagactctctaataatgatgatgtgttgatttctgacatggctggtaactccaatggattcagtgctgtttctattactaaagttgttcctgaagaggaagatgaggagaacatatcttcttcttcaaagttctctagtcaggaattgaataggatagatttcaaacttaggagctttttggatttaggaaatgatgatgatgatacatcctctagaggttttgctctgccatctaaaaagtctcgagcttcaaacttgtgctctcagaatcccttgtgtcaagtttatgggtgtagtaaggatctgagctcttcgaaagattaccacaaaaggcatagagtttgcgaggctcattcgaaaacttctgtggtcatagttaatggtcttgaacagaggttttgtcaacagtgcagcaggtttcatttcctctcagagtttgatgatggcaaaagaagttgcagaaggcgattagccggtcacaatgaacgaagaaggaaacctgcattctatttcctaccgggtaagcgccataagcttcttcgcacctctcaagatgtagtaggcaacaagtttctggagaattcatcattggtattgccagagtcatttcctggtagtctcttatacagagtaatagatgaagacgaccaccgtacaagtagactcgtgagtttcaaagatgaacctacttgttccatgtttcctactaatgagcaaaacagcagcagaacttatgaatctaaaccagcaatttattccacggaagtatcctctatttgggacttacatgagacggcggcatcacgctctactcgtgctctctctcttctgtcagctcagtcccaacaacacttgtctaagtttccaaacacaacgttctcaatcacccaacccaaccaaaatctcaatcactcatcatcaactgactatcatcagatggaacaaccgttgtggatcgatcctggcaagaccaattctgctggttctagttcttgtaaaggaaaaggaacatccacggttgatctactgcaactgtcatcacatcttcaaagaatcgagcaacagaggaattacactggtgatgtgaagcaggaatataatgagctttatttccctggctcctaataaaaggttacaacattcttattcctttaaaccggttcgagtttcttgagattgttctgcagaaggacaagacaagcctgcatggcttgattagtttgtgattagatagaggaattaagaggatcagatcatgttacacgtattattgtaatttgtaactgttgtgttattattcaccagtcaataatgttctgaagaaaattgcttcagatatctaaaaaaaaa

SEQ ID NO: 186 - protein, 405 aa, Arabidopsis thaliana
  G477
MDSWSYGRSVFMSNETLLPCDTFAKNRRFEQRLSNNDDVLISDMAGNSNGFSAVSITKVVPEEEDEENISSSSKFSSQELNRIDFKLRSFLDLGNDDDDTSSRGFALPSKKSRASNLCSQNPLCQVYGCSKDLSSSKDYHKRHRVCEAHSKTSVVIVNGLEQRFCQQCSRFHFLSEFDDGKRSCRRRLAGHNERRRKPAFYFLPGKRHKLLRTSQDVVGNKFLENSSLVLPESFPGSLLYRVIDEDDHRTSRLVSFKDEPTCSMFPTNEQNSSRTYESKPAIYSTEVSSIWDLHETAASRSTRALSLLSAQSQQHLSKFPNTTFSITQPNQNLNHSSSTDYHQMEQPLWIDPGKTNSAGSSSCKGKGTSTVDLLQLSSHLQRIEQQRNYTGDVKQEYNELYFPGS

SEQ ID NO: 187 - DNA, 1337 bp, Arabidopsis thaliana
  CDS (61)..(1050): G1552
actgactctactggtaggtgtatggatttgtgagagaagaaaaaaaagcacaatctttgaatggactggaatttcaaacttagctctggttatttatctggattcgatcaagaaccagatttatcaccaatggatggttcgatctcgtttggtgggtcgtcacagtcaaaagcggatttttcatttgatctaaaacttggaagaaacattggaaactcttcctctgtttttggtgatacagagcaagtgattagtcttagtaagtggaaagatagtgctttagctaaaccagaaggttcaagaagctcgagttcaaagagaacaagagggaatggtgttggaaccaaccagatgccgatttgtcttgttgatggatgtgattctgattttagtaattgtagagagtatcataagagacataaagtttgtgatgttcattcaaaaactcctgtggttactattaatggtcataaacagaggttttgtcaacaatgcagcaggtttcatgctttggaggagtttgatgaagggaagagaagttgtaggaaacgtcttgatggacataatcgaagacgacggaagccgcagcctgaacatatcggtcgtcctgccaacttctttacgggttttcaaggtagcaaattgctagagttttctggtggttcacatgtgtttccaactacatctgtgttgaacccgagctggggaaatagtcttgtaagcgttgctgtagccgccaatggttcgagttatgggcagagccagagctatgttgttggttcttctcctgcaaagacagggataatgtttccaatctcttcttctccaaacagtaccagaagcatagcaaaacaattccctttcttgcaagaagaagaaagctcgagaaccgcatcgttgtgtgagagaatgacgagttgcatccatgactctgattgtgctctctctcttctgtcatcctcctcgtcgtcagtccctcatttgcttcaaccaccactttctttgtcccaagaagcagttgagacagtttttttacgggtcgggattgtttgagaatgcgagtgcagtctctgatggatcggttatatccggtaacgaggctgtccgtcttccgcagacattcccgtttcattgggagtagtagaagaagaagtaggtagatagatagaatcagaaagatctatttgtgtctcttctcttctccctcatttttcaatgttctttatcatcatcattgttcttgttaacactacaagaaatatggacattcttaacacaccgaaaacgctataataacgtttacatagcggattcataaacgctgtgtttgccggaaa

SEQ ID NO: 188 - protein, 330 aa, Arabidopsis thaliana
  G1552
MDWNFKLSSGYLSGFDQEPDLSPMDGSISFGGSSQSKADFSFDLKLGRNIGNSSSVFGDTEQVISLSKWKDSALAKPEGSRSSSSKRTRGNGVGTNQMPICLVDGCDSDFSNCREYHKRHKVCDVHSKTPVVTINGHKQRFCQQCSRFHALEEFDEGKRSCRKRLDGHNRRRRKPQPEHIGRPANFFTGFQGSKLLEFSGGSHVFPTTSVLNPSWGNSLVSVAVAANGSSYGQSQSYVVGSSPAKTGIMFPISSSPNSTRSIAKQFPFLQEEESSRTASLCERMTSCIHDSDCALSLLSSSSSSVPHLLQPPLSLSQEAVETVFLRVGIV

SEQ ID NO: 189 - DNA, 1913 bp, Arabidopsis thaliana
  CDS (6)..(1811): G636
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggttt

SEQ ID NO: 190 - protein, 602 aa, Arabidopsis thaliana
  G636
MQLGGGTPTTTAAATTVTTATAPPPQSNNNDSAATEAAAAAVGAFEVSEEMHDRGFGGNRWPRQETLALLKIRSDMGIAFRDASVKGPLWEEVSRKMAEHGYIRNAKKCKEKFENVYKYHKRTKEGRTGKSEGKTYRFFDQLEALESQSTTSLHHHQQQTPLRPQQNNNNNNNNNNNSSIFSTPPPVTTVMPTLPSSSIPPYTQQINVPSFPNISGDFLSDNSTSSSSSYSTSSDMEMGGGTATTRKKRKRKWKVFFERLMKQVVDKQEELQRTFLEAVEKREHKRLVREESWRVQEIARINREHEILAQERSMSAAKDAAVMAFLQKLSEKQPNQPQPQPQPQQVRPSMQLNNNNQQQPPQRSPPPQPPAPLPQPIQAVVSTLDTTKTHNRGDQNMTPAASASSSRWPKVEIEALIKLRTNLDSKYQENGPKGPLWEEISAGMRRLGFNRNSKRCKEKWENINKYFKKVKESNKKRPEDSKTCPYFHQLDALYRERNKFHSNNNIAASSSSSGLVKPDNSVPLMVQPEQQWPPAVTTATTTPAAAQPDQQSQPSEQNFDDEEGTDEEYDDEDEEEENEEEEGGEFELVPSNNNNNKTTNNL

SEQ ID NO: 191 - DNA, 2136 bp, Arabidopsis thaliana
  CDS (86)..(1858): G638
gaattaaaaggtttaacctttacctttttttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcataaaggacctctttgggatgaagtttctaggattatgtccgaggaacatggataccaaaggagtgggaagaaatgcagagagaagtttgagaatctgtacaaatactatagtaagactaaagaaggcgaagccggaagacaagacggaaaacatcacagatttttccgccagctccaagcgctatacggggattctaataacttggtttcttgtcccaatcataacacgcagttcatgagcagtgctcttcatggtttccatactcaaaaccctatgaacgttgctacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggctttaaccaacgtacgattatatattatgttttcatgtatttattctgtaagactttttaatatcaatctttctctaaa

SEQ ID NO: 192 - protein, 591 aa, Arabidopsis thaliana
  G638
MDQDQHPQYGIPELRQLMKGGGRTTTTTPSTSSHFPSDFFGFNLAPVQPPPHRLHQFTTDQDMGFLPRGIHGLGGGSSTAGNNSNLNASTSGGGVGFSGFLDGGGFGSGVGGDGGGTGRWPRQETLTLLEIRSRLDHKFKEANHKGPLWDEVSRIMSEEHGYQRSGKKCREKFENLYKYYSKTKEGEAGRQDGKHHRFFRQLQALYGDSNNLVSCPNHNTQFMSSALHGFHTQNPMNVATTTSNIHNVDSVHGFHQSLSLSNNYNSSELELMTSSSEGNDSSSRRKKRSWKAKIKEFIDTNMKRLIERQDVWLEKLTKVIEDKEEQRMMKEEEWRKIEAARIDKEHLFWAKERARMEARDVAVIEALQYLTGKPLIKPLCSSPEERTNGNNEIRNNSETQNENGSDQTMTNNVCVKGSSSCWGEQEILKLMEIRTSMDSTFQEILGGCSDEFLWEEIAAKLIQLGFDQRSALLCKEKWEWISNGMRKEKKQINKKRKDNSSSCGVYYPRNEENPIYNNRESGYNDNDPHQINEQGNVGSSTSNANANANVTTGNPSGAMAASTNCFPFFMGDGDQNLWESYGLRLSKEENQ

SEQ ID NO: 193 - DNA, 1399 bp, Arabidopsis thaliana
  CDS (22)..(1215): G639
ttttttttaccttttcccgaaatggaacttctcgccggcgactgtcggaaacgagtcggcgacgactttgaggaagatattaacccattcgatggttcggacggtggttgcgggtggatgtacggtacccgtcaaatgggttctaacggaaacgacgacgctttggctacgctcgcagacttggcttcgcctcctcagaaattgaaacctataaggtgtggcgttaagcttccgtcgtcgtcggaggatcgacatcctcttgatattctcgccggaaccctagataggctgccggagatgggttttggctgcttcgaagctcctttgggatcgaagattgctgacgtggaggaaagtggtcaattgactcgtgggttttcaaaggaagaggatgattctcttcctcctcttcaaatggagtttcaagctcgaaatcgcatctcttgggatggtctctctctcagctcctctgttgatagcagcgatagtgactcatctccagacgttcgcaagaccgtcacgggtaaaagaaagcgggaaacaagggtaaagctggagcatttcttggagaagcttgtggggagtatgatgaagcggcaggagaagatgcataatcagttgattaatgtgatggagaagatggaagtggagagaatacgccgtgaggaagcttggaggcaacaggaaaccgagaggatgacacagaatgaagaagcacggaagcaagagatggcacgcaacttgtctctcatctctttcatcagaagtgttactggtgacgagatcgagatccctaaacagtgtgaattcccgcaaccactccagcagattcttccggaacaatgtaaagacgagaaatgtgaatccgctcagagagaaagagagataaagtttaggtactcaagcggcagtggcagcagtggtagaaggtggccgcaagaggaagtgcaggcattgataagttcgagaagcgatgtggaagagaagacggggatcaacaagggagcgatttgggatgagatatcagcaagaatgaaagaaagagggtacgaaagatctgcgaaaaagtgtaaggagaagtgggagaacatgaacaagtactataggagagtgacggaaggtgggcagaaacagcctgagcacagcaagactcgctcatactttgagaaacttggaaatttttacaagaccatttcctcgggagagagggaaaaatgagtgaaagattttaaatttaggtgtttttggcacgcaaaacgggagaacttgtagatgattacctcgagtttaatttttatatctttggtgtagtttataatttaaaactctacggctctgtatttgtagaaggttcgaataaaaaagacaaatacgttggggtgaaaaaaaaaaaaaaaaa

SEQ ID NO: 194 - protein, 398 aa, Arabidopsis thaliana
  G639
MELLAGDCRKRVGDDFEEDINPFDGSDGGCGWMYGTRQMGSNGNDDALATLADLASPPQKLKPIRCGVKLPSSSEDRHPLDILAGTLDRLPEMGFGCFEAPLGSKIADVEESGQLTRGFSKEEDDSLPPLQMEFQARNRISWDGLSLSSSVDSSDSDSSPDVRKTVTGKRKRETRVKLEHFLEKLVGSMMKRQEKMHNQLINVMEKMEVERIRREEAWRQQETERMTQNEEARKQEMARNLSLISFIRSVTGDEIEIPKQCEFPQPLQQILPEQCKDEKCESAQREREIKFRYSSGSGSSGRRWPQEEVQALISSRSDVEEKTGINKGAIWDEISARMKERGYERSAKKCKEKWENMNKYYRRVTEGGQKQPEHSKTRSYFEKLGNFYKTISSGEREK

SEQ ID NO: 195 - DNA, 1968 bp, Arabidopsis thaliana
  CDS (9)..(1865): G640
aaaagaaaatgtttgatggtggagtacctgagcagatccaccgtttcatagcttctccaccgccaccgcctccgcttccgccgcatcaaccggcggcggaaagatcactaccttttcctgtctcattctcttcctttaacaccaatcatcaacctcagcatatgttgagcttggatagccgtaagatcattcaccatcatcatcatcatcatcaccatgacatcaaagatggtggtgctactactggtgagtggataggtcagacggatcatgatgatagcgataatcatcatcaacatcatcatcatcatccatggtgtagtgatgaagttcttgctcttcttaggttcagatctacagtggagaattggttccctgaattcacttgggagcatacttcaagaaagttggcagaagttggttttaagaggagtccacaagaatgcaaagagaaatttgaagaagaagagagaagatatttcaatagcaacaacaacaacaacaacaacactaatgatcatcaacacatcggcaattataacaacaagggaaataattataggatatttagtgaggttgaagagttttatcatcatggtcatgacaatgaacatgtttcatcagaagttggggataaccaaaacaagaggaccaatttagtagaaggaaaaggaaacgtgggagaaacggtacaagacttaatggcggaggacaaattaagagatcaggatcagggtcaagtagaagaagcatcaatggagaatcaaagaaactctattgaggttggaaaagttggaaacgtagaagatgatgccaagtcatcatcatcatcaagcttgatgatgatcatgaaggagaagaagaggaagaagaggaagaaagagaaagagaggtttggtgtgttaaaagggttttgtgagggtctagtgaggaacatgatagctcaacaagaggagatgcataagaaactcctggaagatatggtgaagaaggaagaagagaagatagcgagagaggaagcttggaagaagcaagagattgagagagttaacaaagaggtagagattagagcacaagaacaagccatggctagtgatagaaacaccaacatcatcaagttcatatccaagtttacagaccatgatcttgatgttgtccaaaacccaacaagcccttctcaagactcatcttctttagctctacgaaaaacccaaggcagaagaaagtttcaaacttcatcatcactattacctcaaaccctaactccacataaccttttaaccattgacaaatcacttgaacctttttctactaaaaccctaaaacccaaaaaccaaaacccaaaacctccaaaaagcgatgataaaagtgatcttggcaagagatggccaaaggatgaagtgttggctctgatcaacattagaagaagtatcagtaacatgaatgatgatgatcataaagatgagaactcattatcaacatcttcaaaagctgttccattatgggaaagaatatccaagaaaatgttggagattgggtacaagagaagtgccaaaagatgcaaagagaaatgggaaaacatcaacaagtattttaggaagacaaaagatgttaacaagaagagaccacttgactcaaggacttgtccttattttcaccaactcacagctttatacagccaaccaccaacagggaccaccgccaccaccgccaccacggccacgtcagccagagatctagacacccgacccgaggaaaaccgggttggatcccaagatcctgatatttctgtacccatgcatgtagatggagatggtgctggcgataaaagcaatgttcagttttcaggtttcgatcttgagttctaataaatcccttctatatatatattatcagttatattctctttttctgctttttgctaaaacctcatttttggttattatgataaagttattatatatgaat

SEQ ID NO: 196 - protein, 619 aa, Arabidopsis thaliana
  G640
MFDGGVPEQIHRFIASPPPPPPLPPHQPAAERSLPFPVSFSSFNTNHQPQHMLSLDSRKIIHHHHHHHHHDIKDGGATTGEWIGQTDHDDSDNHHQHHHHHPWCSDEVLALLRFRSTVENWFPEFTWEHTSRKLAEVGFKRSPQECKEKFEEEERRYFNSNNNNNNNTNDHQHIGNYNNKGNNYRIFSEVEEFYHHGHDNEHVSSEVGDNQNKRTNLVEGKGNVGETVQDLMAEDKLRDQDQGQVEEASMENQRNSIEVGKVGNVEDDAKSSSSSSLMMIMKEKKRKKRKKEKERFGVLKGFCEGLVRNMIAQQEEMHKKLLEDMVKKEEEKIAREEAWKKQEIERVNKEVEIRAQEQAMASDRNTNIIKFISKFTDHDLDVVQNPTSPSQDSSSLALRKTQGRRKFQTSSSLLPQTLTPHNLLTIDKSLEPFSTKTLKPKNQNPKPPKSDDKSDLGKRWPKDEVLALINIRRSISNMNDDDHKDENSLSTSSKAVPLWERISKKMLEIGYKRSAKRCKEKWENINKYFRKTKDVNKKRPLDSRTCPYFHQLTALYSQPPTGTTATTATTATSARDLDTRPEENRVGSQDPDISVPMHVDGDGAGDKSNVQFSGFDLEF

SEQ ID NO: 197 - DNA, 2008 bp, Arabidopsis thaliana
  CDS (90)..(1760): G1382
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 198 - protein, 557 aa, Arabidopsis thaliana
  G1382
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 199 - DNA, 1391 bp, Arabidopsis thaliana
  CDS (53)..(1228): G1669
cggacgcgtgggcggacgcgtgggctctctcactgtgtaatatacacacacaatggtggtcgatgtagagagccgaaccgcgagcgtgacaggagagaagatggcggcgcgtggctgtgatgcgtgcatgaagagatcacgtgctagttggtactgtccagccgatgacgctttcctatgccaaagctgcgacgcctcgatccactcggctaaccatttagcgaaacggcacgaacgtgtccggttacaatcatcttcgccgacggagacggcagacaaaacgacgtcggtatggtacgaaggattcaggagaaaggcgagaacgcctaggagcaagagttgtgcgtttgagaagttgttgcaaatcgagtcaaacgatcctcttgttccggagcttggtggagacgaagatgatggctttttctcgttctcctccgtagaagaaaccgaggagagtctgaattgttgcgtgcctgttttcgatcctttctcagacatgctgattgatgatataaacggcttttgcttagttcctgatgaagtcaataacactactactaatggagaattaggagaagtcgagaaggcaatcatggacgatgaaggttttatggggttcgtgccattggatatggatcttgaggatctcactatggacgtggagagtttacttgaggaagaacaactttgcttgggattcaaggaaccaaacgatgttggagtcatcaaagaagagaataaagtagggtttgagattaattgtaaggatttgaagagggtgaaagatgaagatgaagaagaagaagaagccaagtgtgaaaatggaggatcaaaggatagtgatagagaagcatcaaatgataaagatagaaagacaagtttgtttctgagattagattatggagctgtgattagtgcttgggataatcacggttcgccgtggaaaaccggaatcaaaccggagtgcatgttgggagggaacacgtgtctgcctcatgttgtgggtgggtacgagaaattgatgtcgagcgacggatcggtgacacgtcagcaagggagagacggaggaggatcggacggggagagagaggcgagggttttgaggtacaaggagaagcggaggacgaggttgttctcaaagaaaataagatatgaggttcggaaacttaacgctgagcagagacctcgaatcaaaggtcgtttcgtgaagaggacgtcacttttgacgtgatttgatttactttaatcaacactttaaagatcttgtaattaagacctttgaagtaattgtcgtaatgtactgaataatgaactgaaactcttggggccgatggttgtgtagacttgtagccggcaactatgattttatagattgattgattgagtaaaaa

SEQ ID NO: 200 - protein, 392 aa, Arabidopsis thaliana
  G1669
MVVDVESRTASVTGEKMAARGCDACMKRSRASWYCPADDAFLCQSCDASIHSANHLAKRHERVRLQSSSPTETADKTTSVWYEGFRRKARTPRSKSCAFEKLLQIESNDPLVPELGGDEDDGFFSFSSVEETEESLNCCVPVFDPFSDMLIDDINGFCLVPDEVNNTTTNGELGEVEKAIMDDEGFMGFVPLDMDLEDLTMDVESLLEEEQLCLGFKEPNDVGVIKEENKVGFEINCKDLKRVKDEDEEEEEAKCENGGSKDSDREASNDKDRKTSLFLRLDYGAVISAWDNHGSPWKTGIKPECMLGGNTCLPHVVGGYEKLMSSDGSVTRQQGRDGGGSDGEREARVLRYKEKRRTRLFSKKIRYEVRKLNAEQRPRIKGRFVKRTSLLT

SEQ ID NO: 201 - DNA, 1270 bp, Arabidopsis thaliana
  CDS (156)..(1052): G901
ccaaagagaaaacgtatgagttgcttaaaccataaacctcaagctcaaaattttatcaaccttataaagtttcgttttctcgagattttgaatcttttcagctaaaaaagatcacagctttttgcgttttctggatgagtttgagataagagaagatgaagattcagtgtaacgtttgtgaggcggcggaagcgacggttctatgttgcgccgacgaggctgctctttgttgggcttgcgatgagaaaattcacgccgctaataaactcgccggaaaacatcagagagtccctctctctgcctctgcctcttccatacccaaatgtgacatttgtcaggaagcatctggattcttcttttgtctgcaagatagagctttgctatgtaggaaatgtgatgttgcaatccacactgtgaatcctcatgtttcagctcaccagagatttcttctcactggaatcaaagttggtcttgaatctatagacactggtccttctactaaatcctcacctaccaatgatgataaaaccatggagaccaaaccttttgttcaatctatacctgagcctcaaaagatggccttcgatcatcatcatcaccagcagcagcaggaacagcaggaaggagttataccgggaactaaagtcaatgatcagacatcgacaaagcttcctctcgtaagtagcggatcaactactggaagcattcctcagtggcaaatagaggagattttcgggctaaccgactttgatcagagctatgaatacatggagaataatggatcatctaaggcggatactagtagacgaggagattcagacagttcttcgatgatgagatctgcagaagaagatggagaagataacaataactgcttgggaggtgagacatcatgggcggttccacagattcagtctccacctacagcgtctggtctaaactggcctaagcattttcaccaccactctgtgtttgttccggacataacttcttcaactccttataccggttcatccccgaatcaaagggttgggaaacggcggcgacggttctagcatttgtaattatcttttagccgcttgagaaaagagattggcagctttctcagtagatgtaagatcacataaatgatttggaaacttgtaatgtagtgatctgtgagagtcggtgttctttgttagctgaaaaaacaaaaagatgtttatttggttgaagattataaggggttaaattactaagttatcaatttggcttaaaaaaaaaaaaaaaa

SEQ ID NO: 202 - protein, 299 aa, Arabidopsis thaliana
  G901
MKIQCNVCEAAEATVLCCADEAALCWACDEKIHAANKLAGKHQRVPLSASASSIPKCDICQEASGFFFCLQDRALLCRKCDVAIHTVNPHVSAHQRFLLTGIKVGLESIDTGPSTKSSPTNDDKTMETKPFVQSIPEPQKMAFDHHHHQQQQEQQEGVIPGTKVNDQTSTKLPLVSSGSTTGSIPQWQIEEIFGLTDFDQSYEYMENNGSSKADTSRRGDSDSSSMMRSAEEDGEDNNNCLGGETSWAVPQIQSPPTASGLNWPKHFHHHSVFVPDITSSTPYTGSSPNQRVGKRRRRF

SEQ ID NO: 203 - DNA, 1618 bp, Arabidopsis thaliana
  CDS (96)..(1493): G903
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttatt

SEQ ID NO: 204 - protein, 466 aa, Arabidopsis thaliana
  G903
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 205 - DNA, 906 bp, Arabidopsis thaliana
  CDS (1)..(903): G2119
atggcgtttaatcacagaaaaatgcttctttcatgtctacagtttaaagatttacgcttttgtttccggcaataccctcccccgccaccaccaccaccgccaccgagggagctctctctcctactccccacctcgatctgcgtcgtcggctcaatcatactctttctatttctagtcttcttcctctacctccacatcacgcaacaacggcggatttcagccgccagcgtaactcccggtgacacaaaccaacaggaagatgaggacgaaacagaggagagagatttctccgactttcatcacgtttggcaaatcccaaccgtcggtctccaccgttccgcgatcaactcgatcacagtcgttggattcaaaaagggagaagggataatcgacggcacagaatgctctgtctgcttaaacgagtttgaagaagacgagtcgctgagactgttaccaaagtgtagccatgcctttcatctaaattgcatcgacacttggttgctctctcacaagaactgtcctttatgtcgtgcccctgtacttcttatcactgaaccacctcatcaagaaacagagacgaatcatcaaccagattctgaatcgagcaatgacctccgtggaagacaagacagttccagatctagaagaaaccataacatttttcttccaagggcacaaagtgatttggcaaactactgtggctcaggaagagtagaaaacgtgagaagatcgttttcaattggaggaagcttatcactttgcgatggtattaacaatgctactagaagtggaagacagttctataccagcttcagtgctaacttgttctcatcatcaagaagagtaaggaacgaacaaccgattccacaaaaccaaatgccatccgtaactggtaacaccagttaa

SEQ ID NO: 206 - protein, 301 aa, Arabidopsis thaliana
  G2119
MAFNHRKMLLSCLQFKDLRFCFRQYPPPPPPPPPPRELSLLLPTSICVVGSIILFLFLVFFLYLHITQQRRISAASVTPGDTNQQEDEDETEERDFSDFHHVWQIPTVGLHRSAINSITVVGFKKGEGIIDGTECSVCLNEFEEDESLRLLPKCSHAFHLNCIDTWLLSHKNCPLCRAPVLLITEPPHQETETNHQPDSESSNDLRGRQDSSRSRRNHNIFLPRAQSDLANYCGSGRVENVRRSFSIGGSLSLCDGINNATRSGRQFYTSFSANLFSSSRRVRNEQPIPQNQMPSVTGNTS

SEQ ID NO: 207 - DNA, 2109 bp, Arabidopsis thaliana
  CDS (1)..(2106): G2120
atgtcggtgggatctcttttattcatgtttcttcttatctggaacttcaatggcgaattgaatgctctaaacgacgaagggtttgctcttttaactctgaagcagtctatttcaaaagatccagatggttctttaagcaattggaactcagagaatcaaaacccttgttcttggaatggagtcacttgtgatgataacaaggttgttgtctctcttagcatcccaaagaagaaacttttaggttatcttccttcttctcttggtttactctctaatctccgtcatttgaatttgagaagcaatgagcttagtgggaacttacctgttgagctttttaaggctcaaggtcttcaaagtttggttctttatgggaatttcttgtctgggtccattccaaatgagattggtgacttaaagtttctgcaaattttggatctttctcgtaattctcttaatgggtctattccagaatcggttttgaagtgtaataggcttaggagctttgatttgagtcagaataatctcactggttctgttcctagtggatttggtcagtctttggcttctttgcagaagcttgatctttcttctaacaatcttattggtcttgttcctgatgatttggggaatttgactagattgcaaggaactcttgatttgtctcataattcgtttagtggctcgattccagctagtttggggaatttgcctgagaaagtttatgtcaatctagcttacaacaacttgagtggaccaatcccacaaaccggtgctttggtgaacagaggaccaactgcattcttggggaatccaagactctgtggccctccattgaaggatccttgtttgccagatacggatagttcttcaacttctcacccttttgtaccggataacaacgagcaaggtggaggagggtcaaagaaaggagaaggtttaagtaaaactgctattgttgcaattgtggtttgtgatttcattggaatctgcattgtgggatttctcttctcttgttgttacttgaagatttgtgcacgtcgtaatagtgtggatgaggaaggctatgtgttggagaaagaagggaaagaaaagaaaggttccttctgtttcagaagagatggatcagagtccccttcttcggaaaatcttgagccacaacaagatcttgttctgttggataaacatattgctttggatttagatgagctgcttaaggcttcagctttcgttcttggaaaaggcgggaacgggattgtgtataaagttgtcctcgaagatggtctaacggtcgctgttaggagactgggagaaggaggttcccaaagatgcaaggagtttcagacagaagttgaagcaattgggaagctaaggcatccgaatatcgttagtcttaaagcttattattggtcagttgaagagaaacttctcatctacgactacattcctaatggaagccttaccaatgcactccacggaaatcctggaatggtgtcattcaagcctctgtcttggggagttcggttaaagataatgaggggaatctcaagagggctggtgtatcttcacgagtttagtcctaaaaagtatgttcatggatctctgaaactcagcaatatactgttgggacaggatatggagcctcatatctcggatttcggacttatgcacctctctagcattgctggaacattggaatcaactacagttgaccgaccatccaacaagaccgcctcatcgattggatcatctgcaaacttgagctcattttatctggctcctgaagccactaaagcaacagtgaagccatcacagaaatgggatgtatactcattcggagtgatcttgctagagatgataacgggaagattaccgattgttttcgtgggtaaatcggaaatggagatagtcaagtggatacaaatgtgtatcgatgagaagaaagagatgtcagacattttggatccttatttggtgcctaatgacacagagattgaagaagaggtcatcgccgtgttgaaaattgcaatggcttgtgttagtactagccccgagaaacgtccaccgatgaagcatatcgctgatgctttgacccaaatttgccttcagtga

SEQ ID NO: 208 - protein, 702 aa, Arabidopsis thaliana
  G2120
MSVGSLLFMFLLIWNFNGELNALNDEGFALLTLKQSISKDPDGSLSNWNSENQNPCSWNGVTCDDNKVVVSLSIPKKKLLGYLPSSLGLLSNLRHLNLRSNELSGNLPVELFKAQGLQSLVLYGNFLSGSIPNEIGDLKFLQILDLSRNSLNGSIPESVLKCNRLRSFDLSQNNLTGSVPSGFGQSLASLQKLDLSSNNLIGLVPDDLGNLTRLQGTLDLSHNSFSGSIPASLGNLPEKVYVNLAYNNLSGPIPQTGALVNRGPTAFLGNPRLCGPPLKDPCLPDTDSSSTSHPFVPDNNEQGGGGSKKGEGLSKTAIVAIVVCDFIGICIVGFLFSCCYLKICARRNSVDEEGYVLEKEGKEKKGSFCFRRDGSESPSSENLEPQQDLVLLDKHIALDLDELLKASAFVLGKGGNGIVYKVVLEDGLTVAVRRLGEGGSQRCKEFQTEVEAIGKLRHPNIVSLKAYYWSVEEKLLIYDYIPNGSLTNALHGNPGMVSFKPLSWGVRLKIMRGISRGLVYLHEFSPKKYVHGSLKLSNILLGQDMEPHISDFGLMHLSSIAGTLESTTVDRPSNKTASSIGSSANLSSFYLAPEATKATVKPSQKWDVYSFGVILLEMITGRLPIVFVGKSEMEIVKWIQMCIDEKKEMSDILDPYLVPNDTEIEEEVIAVLKIAMACVSTSPEKRPPMKHIADALTQICLQ

SEQ ID NO: 209 - DNA, 30 bp, Arabidopsis thaliana
  G1090
cgttaaccagttgtcctacagaggcattcg

SEQ ID NO: 210 - DNA, 30 bp, Arabidopsis thaliana
  G1090
cggagacaatcctactcgagaaagtccttg

SEQ ID NO: 211 - DNA, 26 bp, Arabidopsis thaliana
  G732
gcgtcatctagcagcacataccggag

SEQ ID NO: 212 - DNA, 30 bp, Arabidopsis thaliana
  G732
atatcatcgtaatatccgtcgatcccaacc

SEQ ID NO: 213 - DNA, 30 bp, Arabidopsis thaliana
  G467
tcctaatggagggttattcaagaaacggtg

SEQ ID NO: 214 - DNA, 30 bp, Arabidopsis thaliana
  G467
tgagatcaactttacgaccaatgggaacac

SEQ ID NO: 215 - DNA, 30 bp, Arabidopsis thaliana
  G665
cctcctcttcctcttcctttgctggttatc

SEQ ID NO: 216 - DNA, 30 bp, Arabidopsis thaliana
  G665
taatccaattagaaacgtccggtgctcttc

SEQ ID NO: 217 - DNA, 29 bp, Arabidopsis thaliana
  G682
aaacctctcaatttctccagcggttcttc

SEQ ID NO: 218 - DNA, 30 bp, Arabidopsis thaliana
  G682
aggactaagcaacccaagaccaactccatc

We claim:

1. A transgenic plant transformed with a polynucleotide comprising a nucleotide sequence;
   wherein the nucleotide sequence encodes a polypeptide having at least 90% amino acid sequence identity to SEQ ID NO: 162, the polypeptide is a member of the Myb protein family, and the polypeptide comprises a Myb domain;
   wherein the polypeptide regulates expression of at least one gene;
   and wherein when the polypeptide is expressed in the transgenic plant, said expression results in the transgenic plant having greater tolerance to heat as compared to a wild-type plant of the same species.

2. The transgenic plant of claim 1, wherein the polynucleotide comprises a constitutive, inducible, or tissue-specific promoter operably linked to the nucleotide sequence.

3. The transgenic plant of claim 1, wherein the transgenic plant has greater tolerance to 32° C. than the wild-type plant.

4. The transgenic plant of claim 1, wherein the transgenic plant is a germinating seedling.

5. A transgenic seed produced by the transgenic plant of claim 1, wherein the seed comprises a nucleotide sequence encoding a polypeptide having at least 90% amino acid sequence identity to SEQ ID NO: 162.

* * * * *